United States Patent 12,006,502 (THERAPEUTIC COMPOUNDS FOR RED BLOOD CELL-MEDIATED DELIVERY OF AN ACTIVE PHARMACEUTICAL INGREDIENT TO A TARGET CELL) - sequence listing, part 2

SEQ ID NO: 694 - RNA, 7477 nt, Homo sapiens
  source 1..7477: mol_type = unassigned RNA; note = Homo sapiens ubiquitin protein ligase E3A (UBE3A), transcript variant 26, mRNA, NCBI Reference Sequence: NM_001354550.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 695 - RNA, 7293 nt, Homo sapiens
  source 1..7293: mol_type = unassigned RNA; note = Homo sapiens ubiquitin protein ligase E3A (UBE3A), transcript variant 27, mRNA, NCBI Reference Sequence: NM_001354551.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 696 - RNA, 7249 nt, Homo sapiens
  source 1..7249: mol_type = unassigned RNA; note = Homo sapiens ubiquitin protein ligase E3A (UBE3A), transcript variant 29, mRNA, NCBI Reference Sequence: NM_001374461.1
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaaggtaattttgaattattttacagcctttaaaaggctgtcattgtaaagtgaaatacatactgtaaaaatgaagacaatgtatagttggcaggaatactgctaagaatagtgggcctgagagttgacctacttcatttaatctccttaaaatattttagtgtctttttttctcattaaaaatatcagtagccactatcaaagacctatctgtatgtataaacaggaaagtatttctcaaaaaaacttcaaggttttaaacattttactataaacattatagaaaacattaaaaatttcttaatatgcattttaaagtatgccttttatgtggtgaacgttttaactaaacatttctctagaagtttttataacattaataaaactagtatacttttctctcctagagagttacagtggaggtaaaaggagtggcttgcaggatggagaagctgcaccagtgttattggaagtgagccaccatttgaatttgctagctcatgctgcagtattcagattagtgggtgttttgtgatcatattttctgcgattcaaatcaagacctaaaattgattctcattctgagatttacattttattatccaatgttatttggttattgtttcagttttaaaatttctgacttgttattctgacacactttaggataacctaagtcaatagtttaatacaaaaatttccctttggttatatgttttgaattaggttatatgttctgcatttacaagcacatacaggattcttacttccagcaacttggcagtaaaagaataagtagactctttaggagccaaagtcaagcttgggaactgttgctaggtggtatatatttcatagtttatgtttgtttccaagacaaggtctcactccatcgcccaggctggagtgcagtggcacgatcacagttcactgcaactttgaccttctgggctcaagtgaccctcccacctcagcctcccaagttgctgggactaaaggcacccaccaccacacccggctaagagacgaggtttcatcatgttgcccaggttgaccttgaactcctgagctcaagtggtccttatgtcttgacctcccaaagtgctgagattacagacatgaactaccacacctggcatatgtcatagttttgagagtttgaattctaacctcgggactttggtaacttatttataatattctagaaatatactgttattaggatgagtagaaattcattcagacagaaactattataaattactgcaagaaaaatgtctgctagttctgcatatattcatttttctcttgattaaaaaacaatttccaatttgagtagaacaactttgctatgtttaatagacccaggacagatttattttaaggtaataatctttcaatccttcttcttctatactggattggtttaaattacttagcttgtcttatcaatggtttttaatagcctactttaatatatgtaaaaagtagtaattaatatgttacagtttggtggcaaacattttgatgccaaagttcacatattctcttgcttagggaacagaaattgggaagatagatgtagttatcatttgataatgtatttaaactctatcccatttcaggatctcaaaactttgtaacagttacatattgtacttctaagacttagatttgtttttcttcttgtgtcttacctttttgcagtaatatttttattttcctatcatcatgtcctcattttttccctctcttctctttccctgttaattttgaaagttttgctgcctacgtgtttgaaaacttctaatctgcctctcttccctcagtgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctc

SEQ ID NO: 697 - RNA, 8540 nt, Homo sapiens
  source 1..8540: mol_type = unassigned RNA; note = Homo sapiens ubiquitin protein ligase E3A (UBE3A), transcript variant 28, non-coding RNA, NCBI Reference Sequence: NR_148916.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 698 - RNA, 5143 nt, Homo sapiens
  source 1..5143: mol_type = unassigned RNA; note = Homo sapiens ubiquitin protein ligase E3A (UBE3A), transcript variant X1, mRNA, NCBI Reference Sequence: XM_011521995.3
gcccctggtggccgcggctgctgcagccgtaactgtcagtcctggctgagcgacggcgggagggttttgtcgcccgaggggacgcgagcgggcccggggcggggcgggacgtgcgaggcgtcgagatttgggcctcctaggagccaggctcttcgagccagccggggccccagacagggaagggcaggccctttccttcaaaggggagccctttctcggcgttttcaaggtttttggctctcttggggaagacatatttagccgtgtgcttgaggggaggtatggtgtcaagaaaacatagtcaccattattacgaaaagtaaaatatggaagagatgatccctaccatcaatcagcttacaactagaggcactgacaaatgtatacagatagctgtaatgtaaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaaatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaa

SEQ ID NO: 699 - RNA, 5699 nt, Homo sapiens
  source 1..5699: mol_type = unassigned RNA; note = Homo sapiens ubiquitin protein ligase E3A (UBE3A), transcript variant X3, mRNA, NCBI Reference Sequence: XM_017022547.2
ctgcaaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacagaggggaggtatggtgtcaagaaaacatagtcaccattattacgaaaagtaaaatatggaagagatgatccctaccatcaatcagcttacaactagaggcactgacaaatgtatacagatagctgtaatgtaaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaa

SEQ ID NO: 700 - RNA, 5694 nt, Homo sapiens
  source 1..5694: mol_type = unassigned RNA; note = Homo sapiens ubiquitin protein ligase E3A (UBE3A), transcript variant X4, mRNA, NCBI Reference Sequence: XM_017022548.2
ctgcaaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacagaggggaggtatggtgtcaagaaaacatagtcaccattattacgaaaagtaaaatatggaagagatgatccctaccatcaatcagcttacaactagaggcactgacaaatgtatacagatagctgtaatgttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaa

SEQ ID NO: 701 - RNA, 6170 nt, Homo sapiens
  source 1..6170: mol_type = unassigned RNA; note = Homo sapiens ubiquitin protein ligase E3A (UBE3A), transcript variant X5, mRNA, NCBI Reference Sequence: XM_017022550.2
ttttttttttttttttttttttttgtagagatggggtcttcctatgttgcccactttggtttgttagttttagtagtttataattcctttgtattattgtgaacaaataacagttattttgaaatagaagagtgctttctatttaaaattttgctttgatagggttctgtctactttctgagccttaccttcctgtgcattcccctttggtcagtaccatcttaccacacaggctgcttttagtttcttgagttatccatcttccttctatcttatagggctcaacctaaatattactcagggaagccttccttgagagtctttctttttgcactcattggtttggggcttctttatattatactgttaattgaattctgagtcgtgtttatctcaactgagattaggtaatttattttgagaacagtaaatgtttatcatctgtcattctttttttcatgcccacattcagttatttgtaagtgctgaatgtataagtgttcatctacagataaggatcagttcttttttccccaactagaaatgttactccagttgataataacagctcaaacggaaatataaggcagaggtgagagagtcacttgaggccacgaattggagaccagcctgggcaacaaagtgagaccttatccctatgaaaaataaaattagcccagcttgggaggctgaggtggggggattgcttgaaccctggagttccaggctgcagtgagttgttatcacaccactgcactccagccgcggtgacagaccctgtcccttaaaaaaaaaaaaattataaccagccacattgaaatattttgtaagacattaatagaagactaaatgttctcatatgtttactgtttgtgttaagtacgtatggtttttagaacaacagttttctatcaagtgtggtctggttcacttagaattagatggggtagattttttgaaaagcgttttgaagttaaattagaagctaatggttttttgtcactaaatcaaattttgttttatgcgtttaagtgctacatttatttgataggcaggtgaatgtaacagattaaacttgaaaataatgtagctatgattccttcaaggaaaaacccacctacctttagttcttttagtatattgcattataagtcttttgtgtgtgcatatatagcaggcataaattggcataattctgggtttaattttaggctaggcgctatggaagtttgaactctaattacagtgtaaaaataacccagaggaaaatttcagaataataaatcattgggactatatggtacagatgtccctgttttcagattgtagaattgttgaccagtaggaatgctttatgattaaaagccaggaaattaaagtaattctgatgatttggtatttctaaagattttcatagatgacagttgagaactactctcagatgagattcttccattgctgggtaaataccttaaattggaattactgggtcacatggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaa

SEQ ID NO: 702 - RNA, 5135 nt, Homo sapiens
  source 1..5135: mol_type = unassigned RNA; note = Homo sapiens ubiquitin protein ligase E3A (UBE3A), transcript variant X7, mRNA, NCBI Reference Sequence: XM_017022556.2
agccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaaatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaagaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttca

SEQ ID NO: 703 - RNA, 4866 nt, Homo sapiens
  source 1..4866: mol_type = unassigned RNA; note = Homo sapiens ubiquitin protein ligase E3A (UBE3A), transcript variant X2, mRNA, NCBI Reference Sequence: XM_024450043.1
aggggaggtatggtgtcaagaaaacatagtcaccattattacgaaaagtaaaatatggaagagatgatccctaccatcaatcagcttacaactagaggcactgacaaatgtatacagatagctgtaatgttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaaatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaa

SEQ ID NO: 704 - RNA, 5617 nt, Homo sapiens
  source 1..5617: mol_type = unassigned RNA; note = Homo sapiens ret proto-oncogene (RET), transcript variant 2, mRNA, NCBI Reference Sequence: NM_020975.6
agtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagctgcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgattttttttaaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttgtggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaa

SEQ ID NO: 705 - RNA, 4269 nt, Homo sapiens
  source 1..4269: mol_type = unassigned RNA; note = Homo sapiens ret proto-oncogene (RET), transcript variant 4, mRNA, NCBI Reference Sequence: NM_020630.6
agtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagctgcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctttgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggatgtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattttttctgtttcctaacttcatcattgattgtttgaaatcttggagtttcaagcatttttttcaagctgagacggttccttttgcatgcctcctgactcactgactcctcac

SEQ ID NO: 706 - RNA, 3674 nt, Homo sapiens
  source 1..3674: mol_type = unassigned RNA; note = Homo sapiens ret proto-oncogene (RET), transcript variant 5, mRNANCBI Reference Sequence: NM_001355216.1
acagtcatcgctgcaaactgcaaactcgtaagcacagtcatcgctgcaaactgcaaactcgtgctccgagcgctgccctcccctgtggagcggaggaggggaggcctggggccgcggcggtgtgcgccccgctctgaccgcagagcccccttcccgaggaaagcggctggcccggtcccggctggtgatcacgcggggcccctgtctgcttggtgcgcaggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagctgcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctttgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggatgtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattttttctgtttcctaacttcatcattgattgtttgaaatcttggagtttcaagcatttttttcaagctgagacggttccttttgcatgcctcctgactcactgactcctcac

SEQ ID NO: 707 - RNA, 1223 nt, Homo sapiens
  source 1..1223: mol_type = unassigned RNA; note = Homo sapiens SSX family member 1 (SSX1), transcript variant 2, mRNA, NCBI Reference Sequence: NM_005635.4
accactgctgccgacctcgcaaccactgctttgtctctgaagtgagactgctcctggtgccatgaacggagacgacacctttgcaaagagacccagggatgatgctaaagcatcagagaagagaagcaaggcctttgatgatattgccacatacttctctaagaaagagtggaaaaagatgaaatactcggagaaaatcagctatgtgtatatgaagagaaactataaggccatgactaaactaggtttcaaagtcaccctcccacctttcatgtgtaataaacaggccacagacttccaggggaatgattttgataatgaccataaccgcaggattcaggttgaacatcctcagatgactttcggcaggctccacagaatcatcccgaagatcatgcccaagaagccagcagaggacgaaaatgattcgaagggagtgtcagaagcatctggcccacaaaacgatgggaaacaactgcaccccccaggaaaagcaaatatttctgagaagattaataagagatctggacccaaaagggggaaacatgcctggacccacagactgcgtgagagaaagcagctggtgatttatgaagagatcagtgaccctgaggaagatgacgagtaactcccctgggggatacgacacatgcccttgatgagaagcagaacgtggtgacctttcacgaacatgggcatggctgcggctccctcgtcatcaggtgcatagcaagtgaaagcaagtgttcacaacggtgaaacttgagcgtcatttttcttagtgtgccaagagttcgatgttagtgtttccattgtattttcttacagtgtgccattctgttagatactatccttataattgatgagcaagacatactgaatgcatatttcggtttgtgtatccatgcacctacgtcagaaaacaagtattgtcaggtattctctccatagaacagcactatcctcatctctccccagatgtgactactgagggcagttctgagtgtttaatttcagactttttcctctgcatttacacacacacacacacacacacgcacacacacacaccaagtaccagtataagcatctcccatctgcttttcccattgccatgcgtcctggtcaagcccccctcactctgtttcctgttcagcatgtactcccctcatccgattcccctgtatcagtcactgacagttaataaacctttgcaaacgttc

SEQ ID NO: 708 - RNA, 1309 nt, Homo sapiens
  source 1..1309: mol_type = unassigned RNA; note = Homo sapiens SSX family member 1 (SSX1), transcript variant 1, mRNA, NCBI Reference Sequence: NM_001278691.2
accactgctgccgacctcgcaaccactgctttgtctctgaatagagacagggtttccttatgttggccgaactgggcttgacctcctcggctcaagtgatcctcccacctcggcctcggaactacaggtgagactgctcctggtgccatgaacggagacgacacctttgcaaagagacccagggatgatgctaaagcatcagagaagagaagcaaggcctttgatgatattgccacatacttctctaagaaagagtggaaaaagatgaaatactcggagaaaatcagctatgtgtatatgaagagaaactataaggccatgactaaactaggtttcaaagtcaccctcccacctttcatgtgtaataaacaggccacagacttccaggggaatgattttgataatgaccataaccgcaggattcaggttgaacatcctcagatgactttcggcaggctccacagaatcatcccgaagatcatgcccaagaagccagcagaggacgaaaatgattcgaagggagtgtcagaagcatctggcccacaaaacgatgggaaacaactgcaccccccaggaaaagcaaatatttctgagaagattaataagagatctggacccaaaagggggaaacatgcctggacccacagactgcgtgagagaaagcagctggtgatttatgaagagatcagtgaccctgaggaagatgacgagtaactcccctgggggatacgacacatgcccttgatgagaagcagaacgtggtgacctttcacgaacatgggcatggctgcggctccctcgtcatcaggtgcatagcaagtgaaagcaagtgttcacaacggtgaaacttgagcgtcatttttcttagtgtgccaagagttcgatgttagtgtttccattgtattttcttacagtgtgccattctgttagatactatccttataattgatgagcaagacatactgaatgcatatttcggtttgtgtatccatgcacctacgtcagaaaacaagtattgtcaggtattctctccatagaacagcactatcctcatctctccccagatgtgactactgagggcagttctgagtgtttaatttcagactttttcctctgcatttacacacacacacacacacacacgcacacacacacaccaagtaccagtataagcatctcccatctgcttttcccattgccatgcgtcctggtcaagcccccctcactctgtttcctgttcagcatgtactcccctcatccgattcccctgtatcagtcactgacagttaataaacctttgcaaacgttc

SEQ ID NO: 709 - RNA, 3402 nt, Homo sapiens
  source 1..3402: mol_type = unassigned RNA; note = Homo sapiens SS18 subunit of BAF chromatin remodeling complex (SS18), transcript variant 1, mRNA, NCBI Reference Sequence: NM_001007559.3
acccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaa

SEQ ID NO: 710 - RNA, 3309 nt, Homo sapiens
  source 1..3309: mol_type = unassigned RNA; note = Homo sapiens SS18 subunit of BAF chromatin remodeling complex (SS18), transcript variant 2, mRNA, NCBI Reference Sequence: NM_005637.4
acccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaa

SEQ ID NO: 711 - RNA, 3413 nt, Homo sapiens
  source 1..3413: mol_type = unassigned RNA; note = Homo sapiens SS18 subunit of BAF chromatin remodeling complex (SS18), transcript variant 3, mRNA, NCBI Reference Sequence: NM_001308201.2
gtccttccacctctgccctatctcggcagatgctccacggatttgcacgaactcccgagtcttgacctccctcccctctccgggctgccgggacaactcggggcggccactcttgccaggaggcatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaa

SEQ ID NO: 712 - RNA, 2383 nt, Homo sapiens
  source 1..2383: mol_type = unassigned RNA; note = Homo sapiens SS18 subunit of BAF chromatin remodeling complex (SS18), transcript variant X7, mRNA, NCBI Reference Sequence: XM_006722527.2
ggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcagtgtgattcaagtaaggtgaaggaacacatgcttagagctgtggaacattttgaagattagcagccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttac

SEQ ID NO: 713 - RNA, 3404 nt, Homo sapiens
  source 1..3404: mol_type = unassigned RNA; note = Homo sapiens SS18 subunit of BAF chromatin remodeling complex (SS18), transcript variant X1, mRNA, NCBI Reference Sequence: XM_011526145.1
tgccctatctcggcagatgctccacggatttgcacgaactcccgagtcttgacctccctcccctctccgggctgccgggacaactcggggcggccactcttgccaggaggcgtaaatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaa

SEQ ID NO: 714 - RNA, 2608 nt, Homo sapiens
  source 1..2608: mol_type = unassigned RNA; note = Homo sapiens SS18 subunit of BAF chromatin remodeling complex (SS18), transcript variant X2, mRNA, NCBI Reference Sequence: XM_011526147.2
gagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcaatctggccagtgggagcccctcaagctggcttcttgatatgtcttcattattttttgaacatttacttattttcttataccacaaaatgttctaggctcatcctggtttttttttcctgtgcagggtgagtccaaactattccagagttgcataaatttcaaacaacaaaaaaaattagtgtcgatcattcatcgtaatttaaaagagttgtttaaatctgtagtttggaagataacttttattctataaagtgcattcccgttgtctaataaatattcatagcttctaggtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttac

SEQ ID NO: 715 - RNA, 2595 nt, Homo sapiens
  source 1..2595: mol_type = unassigned RNA; note = Homo sapiens SS18 subunit of BAF chromatin remodeling complex (SS18), transcript variant X3, mRNA, NCBI Reference Sequence: XM_011526148.2
agtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcaatctggccagtgggagcccctcaagctggcttcttgatatgtcttcattattttttgaacatttacttattttcttataccacaaaatgttctaggctcatcctggtttttttttcctgtgcagcatatctctttttttctgtagttggagattgcctattcattgccttctctatatgctgtgtcctgatagatgggtagtataaacacagtgggcctaagttgttggtcattgctacagtagtgaaaaggaaaaaaaggtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttac

SEQ ID NO: 716 - RNA, 2620 nt, Homo sapiens
  source 1..2620: mol_type = unassigned RNA; note = Homo sapiens SS18 subunit of BAF chromatin remodeling complex (SS18), transcript variant X5, mRNA, NCBI Reference Sequence: XM_011526149.2
agtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcaggtgagtccaaactattccagagttgcataaatttcaaacaacaaaaaaaattagtgtcgatcattcatcgtaatttaaaagagttgtttaaatctgtagtttggaagataacttttattctataaagtgcattcccgttgtctaataaatattcatagcttctagggtcatgaataaaccacatctgttagtatggtttggtcagtggtcctcagaaaatctcatgtcgtgcaaccatactaatactcaagcaaaggaaaacttgaaggcctagactgaaacaggtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttac

SEQ ID NO: 717 - RNA, 2480 nt, Homo sapiens
  source 1..2480: mol_type = unassigned RNA; note = Homo sapiens SS18 subunit of BAF chromatin remodeling complex (SS18), transcript variant X4, mRNA, NCBI Reference Sequence: XM_011526150.2
gctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcaggtgagtccaaactattccagagttgcataaatttcaaacaacaaaaaaaattagtgtcgatcattcatcgtaatttaaaagagttgtttaaatctgtagtttggaagataacttttattctataaagtgcattcccgttgtctaataaatattcatagcttctaggtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttac

SEQ ID NO: 718 - RNA, 2609 nt, Homo sapiens
  source 1..2609: mol_type = unassigned RNA; note = Homo sapiens SS18 subunit of BAF chromatin remodeling complex (SS18), transcript variant X6, mRNA, NCBI Reference Sequence: XM_011526151.2
agatgctccacggatttgcacgaactcccgagtcttgacctccctcccctctccgggctgccgggacaactcggggcggccactcttgccaggaggcatgttggatgacaataaccatcttattcagtgtataatggactctcagaataaaggaaagacctcagagtgttctcaggtgagtccaaactattccagagttgcataaatttcaaacaacaaaaaaaattagtgtcgatcattcatcgtaatttaaaagagttgtttaaatctgtagtttggaagataacttttattctataaagtgcattcccgttgtctaataaatattcatagcttctagcatatctctttttttctgtagttggagattgcctattcattgccttctctatatgctgtgtcctgatagatgggtagtataaacacagtgggcctaagttgttggtcattgctacagtagtgaaaaggaaaaaaaggtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttac

SEQ ID NO: 719 - RNA, 2387 nt, Homo sapiens
  source 1..2387: mol_type = unassigned RNA; note = Homo sapiens SS18 subunit of BAF chromatin remodeling complex (SS18), transcript variant X8, mRNA, NCBI Reference Sequence: XM_011526152.2
gctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcaggtgagtccaaactattccagagttgcataaatttcaaacaacaaaaaaaattagtgtcgatcattcatcgtaatttaaaagagttgtttaaatctgtagtttggaagataacttttattctataaagtgcattcccgttgtctaataaatattcatagcttctaggtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttac

SEQ ID NO: 720 - RNA, 3745 nt, Homo sapiens
  source 1..3745: mol_type = unassigned RNA; note = Homo sapiens RecQ like helicase (RECQL), transcript variant 1, mRNA, NCBI Reference Sequence: NM_002907.4
gtggatgctctcagctggctggcgggaagattttactcccgagtagcggaaagatctgctcgaggcctgggtgctttggtgtcggagatccgagagtcggagatcggagagtcggacacaggacagtcggacaccggacagtcaaacaccggagagttagaccgggcttctcggtggggagaggctctgggataactactgttacagctttgaagggtcaagggtgtgcgctttttgtttcatccttccctttcctgctgcagggcgaggccggtctgtagcggatcacttcctttcgcccacacattggcggaggagaaaccggaaagttaatcactgccctgctctgagaactcgggcctttaggggcacgttcgcctgctgaccggtcttctgatctccccattcttttccatgcaggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgctaacactgacgatagctgatgagcttaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgctccaaagctaaatcacaagtaaacatatttatgtttaaaacacagaaataaataacttaagatttttatctaagcggtcagtgttgtattggaaagatatatctataaataaactttgaactgatttcaaactta

SEQ ID NO: 721 - RNA, 3548 nt, Homo sapiens
  source 1..3548: mol_type = unassigned RNA; note = Homo sapiens RecQ like helicase (RECQL), transcript variant 2, mRNA, NCBI Reference Sequence: NM_032941.3
gtggatgctctcagctggctggcgggaagattttactcccgagtagcggaaagatctgctcgaggcctgggtgctttggtgtcggagatccgagagtcggagatcggagagtcggacacaggacagtcggacaccggacagtcaaacaccggagagttagaccgggcttctcggtggggagaggctctgggataactactgttacagctttgaagggtcaagggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgctaacactgacgatagctgatgagcttaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgctccaaagctaaatcacaagtaaacatatttatgtttaaaacacagaaataaataacttaagatttttatctaagcggtcagtgttgtattggaaagatatatctataaataaactttgaactgatttcaaactta

SEQ ID NO: 722 - RNA, 3653 nt, Homo sapiens
  source 1..3653: mol_type = unassigned RNA; note = Homo sapiens RecQ like helicase (RECQL), transcript variant X2, mRNA, NCBI Reference Sequence: XM_005253461.3
ggatgctctcagctggctggcgggaagattttactcccgagtagcggaaagatctgctcgaggcctgggtgctttggtgtcggagatccgagagtcggagatcggagagtcggacacaggacagtcggacaccggacagtcaaacaccggagagttagaccgggcttctcgggcgaggccggtctgtagcggatcacttcctttcgcccacacattggcggaggagaaaccggaaagttaatcactgccctgctctgagaactcgggcctttaggggcacgttcgcctgctgaccggtcttctgatctccccattcttttccatgcaggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgctaacactgacgatagctgatgagcttaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgctccaaagctaaatcacaagtaaacatatttatgtttaaaacacagaaataaataacttaagatttttatctaagcggtcagtgttgtattggaaagatatatctataaataaactttgaactgatttcaaactta

SEQ ID NO: 723 - RNA, 3351 nt, Homo sapiens
  source 1..3351: mol_type = unassigned RNA; note = Homo sapiens RecQ like helicase (RECQL), transcript variant X4, mRNA, NCBI Reference Sequence: XM_005253462.5
agctggctggcgggaagattttactcccgagtagcggaaagatctgctcgaggcctgggtgctttggtgtcggagatccgagagtcggagatcggagagtcggacacaggacagtcggacaccggacagtcaaacaccggagagttagaccgggcttctcggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgctaacactgacgatagctgatgagcttaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgc

SEQ ID NO: 724 - RNA, 3367 nt, Homo sapiens
  source 1..3367: mol_type = unassigned RNA; note = Homo sapiens RecQ like helicase (RECQL), transcript variant X3, mRNA, NCBI Reference Sequence: XM_005253463.4
gtggatgctctcagctggctggcgggaagattttactcccgagtagcggaaagatctgctcgaggcctgggtgctttggtgtcggagatccgagagtcggagatcggagagtcggacacaggacagtcggacaccggacagtcaaacaccggagagttagaccgggcttctcggtggggagaggctctgggataactactgttacagctttgaagggtcaaggaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgctaacactgacgatagctgatgagcttaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgc

SEQ ID NO: 725 - RNA, 3317 nt, Homo sapiens
  source 1..3317: mol_type = unassigned RNA; note = Homo sapiens RecQ like helicase (RECQL), transcript variant X1, mRNA, NCBI Reference Sequence: XM_005253464.4
gtggatgctctcagctggctggcgggaagattttactcccgagtagcggaaagatctgctcgaggcctgggtgctttggtgtcggagatccgagagtcggagatcggagagtcggacacaggacagtcggacaccggacagtcaaacaccggagagttagaccgggcttctcgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgctaacactgacgatagctgatgagcttaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgc

SEQ ID NO: 726 - RNA, 2474 nt, Homo sapiens
  source 1..2474: mol_type = unassigned RNA; note = Homo sapiens RAN, member RAS oncogene family (RAN), transcript variant 1, mRNA, NCBI Reference Sequence: NM_006325.5
gaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 727 - RNA, 2420 nt, Homo sapiens
  source 1..2420: mol_type = unassigned RNA; note = Homo sapiens RAN, member RAS oncogene family (RAN), transcript variant 2, mRNA, NCBI Reference Sequence: NM_001300796.2
gaattgcgcttccgccatctttccagcctcagtcggacgggcgcggagacgcttctggaagcttgtattggttggtgatggtggtactggaaaaacgaccttcgtgaaacgtcatttgactggtgaatttgagaagaaccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 728 - RNA, 2428 nt, Homo sapiens
  source 1..2428: mol_type = unassigned RNA; note = Homo sapiens RAN, member RAS oncogene family (RAN), transcript variant 3, mRNA, NCBI Reference Sequence: NM_001300797.2
gaattgcgcttccgccatctttccagcctcagtcggacgggcgcggagacgcttctggaagcttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 729 - RNA, 2760 nt, Homo sapiens
  source 1..2760: mol_type = unassigned RNA; note = Homo sapiens RAN, member RAS oncogene family (RAN), transcript variant X1, mRNA, NCBI Reference Sequence: XM_017019772.1
accgcgcctcccgccccaccctaagcgcagcgaccgcccgagcggccgaccgaaccgcgttgcgtgcgtgcgcgcacgcgcgggccacgtgggcgggcgccgcgccgttgccccgccccttgcaaccccgccccgcgccggccccgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggtattgtggccactttgctgttcagattgttcggtttggcttgtttattcctggcagttttgatctggagtgttaacgtttttccatctcttcgtctaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 730 - RNA, 2497 nt, Homo sapiens
  source 1..2497: mol_type = unassigned RNA; note = Homo sapiens RAN, member RAS oncogene family (RAN), transcript variant X2, mRNA, NCBI Reference Sequence: XM_017019773.1
agtcggacgggcgcggagacgcttctggaagcttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggtattgtggccactttgctgttcagattgttcggtttggcttgtttattcctggcagttttgatctggagtgttaacgtttttccatctcttcgtctaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 731 - RNA, 5205 nt, Homo sapiens
  source 1..5205: mol_type = unassigned RNA; note = Homo sapiens ATP binding cassette subfamily B member 1 (ABCB1), transcript variant 4, mRNA, NCBI Reference Sequence: NM_001348946.2
attcgagtagcggctcttccaagctcaaagaagcagaggccgctgttcgtttcctttaggtctttccactaaagtcggagtatcttcttccaaaatttcacgtcttggtggccgttccaaggagcgcgaggtcggaatggatcttgaaggggaccgcaatggaggagcaaagaagaagaacttttttaaactgaacaataaaagtgaaaaagataagaaggaaaagaaaccaactgtcagtgtattttcaatgtttcgctattcaaattggcttgacaagttgtatatggtggtgggaactttggctgccatcatccatggggctggacttcctctcatgatgctggtgtttggagaaatgacagatatctttgcaaatgcaggaaatttagaagatctgatgtcaaacatcactaatagaagtgatatcaatgatacagggttcttcatgaatctggaggaagacatgaccaggtatgcctattattacagtggaattggtgctggggtgctggttgctgcttacattcaggtttcattttggtgcctggcagctggaagacaaatacacaaaattagaaaacagttttttcatgctataatgcgacaggagataggctggtttgatgtgcacgatgttggggagcttaacacccgacttacagatgatgtctccaagattaatgaaggaattggtgacaaaattggaatgttctttcagtcaatggcaacatttttcactgggtttatagtaggatttacacgtggttggaagctaacccttgtgattttggccatcagtcctgttcttggactgtcagctgctgtctgggcaaagatactatcttcatttactgataaagaactcttagcgtatgcaaaagctggagcagtagctgaagaggtcttggcagcaattagaactgtgattgcatttggaggacaaaagaaagaacttgaaaggtacaacaaaaatttagaagaagctaaaagaattgggataaagaaagctattacagccaatatttctataggtgctgctttcctgctgatctatgcatcttatgctctggccttctggtatgggaccaccttggtcctctcaggggaatattctattggacaagtactcactgtattcttttctgtattaattggggcttttagtgttggacaggcatctccaagcattgaagcatttgcaaatgcaagaggagcagcttatgaaatcttcaagataattgataataagccaagtattgacagctattcgaagagtgggcacaaaccagataatattaagggaaatttggaattcagaaatgttcacttcagttacccatctcgaaaagaagttaagatcttgaagggtctgaacctgaaggtgcagagtgggcagacggtggccctggttggaaacagtggctgtgggaagagcacaacagtccagctgatgcagaggctctatgaccccacagaggggatggtcagtgttgatggacaggatattaggaccataaatgtaaggtttctacgggaaatcattggtgtggtgagtcaggaacctgtattgtttgccaccacgatagctgaaaacattcgctatggccgtgaaaatgtcaccatggatgagattgagaaagctgtcaaggaagccaatgcctatgactttatcatgaaactgcctcataaatttgacaccctggttggagagagaggggcccagttgagtggtgggcagaagcagaggatcgccattgcacgtgccctggttcgcaaccccaagatcctcctgctggatgaggccacgtcagccttggacacagaaagcgaagcagtggttcaggtggctctggataaggccagaaaaggtcggaccaccattgtgatagctcatcgtttgtctacagttcgtaatgctgacgtcatcgctggtttcgatgatggagtcattgtggagaaaggaaatcatgatgaactcatgaaagagaaaggcatttacttcaaacttgtcacaatgcagacagcaggaaatgaagttgaattagaaaatgcagctgatgaatccaaaagtgaaattgatgccttggaaatgtcttcaaatgattcaagatccagtctaataagaaaaagatcaactcgtaggagtgtccgtggatcacaagcccaagacagaaagcttagtaccaaagaggctctggatgaaagtatacctccagtttccttttggaggattatgaagctaaatttaactgaatggccttattttgttgttggtgtattttgtgccattataaatggaggcctgcaaccagcatttgcaataatattttcaaagattataggggtttttacaagaattgatgatcctgaaacaaaacgacagaatagtaacttgttttcactattgtttctagcccttggaattatttcttttattacatttttccttcagggtttcacatttggcaaagctggagagatcctcaccaagcggctccgatacatggttttccgatccatgctcagacaggatgtgagttggtttgatgaccctaaaaacaccactggagcattgactaccaggctcgccaatgatgctgctcaagttaaaggggctataggttccaggcttgctgtaattacccagaatatagcaaatcttgggacaggaataattatatccttcatctatggttggcaactaacactgttactcttagcaattgtacccatcattgcaatagcaggagttgttgaaatgaaaatgttgtctggacaagcactgaaagataagaaagaactagaaggttctgggaagatcgctactgaagcaatagaaaacttccgaaccgttgtttctttgactcaggagcagaagtttgaacatatgtatgctcagagtttgcaggtaccatacagaaactctttgaggaaagcacacatctttggaattacattttccttcacccaggcaatgatgtatttttcctatgctggatgtttccggtttggagcctacttggtggcacataaactcatgagctttgaggatgttctgttagtattttcagctgttgtctttggtgccatggccgtggggcaagtcagttcatttgctcctgactatgccaaagccaaaatatcagcagcccacatcatcatgatcattgaaaaaacccctttgattgacagctacagcacggaaggcctaatgccgaacacattggaaggaaatgtcacatttggtgaagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttgatggcaaagaaataaagcgactgaatgttcagtggctccgagcacacctgggcatcgtgtcccaggagcccatcctgtttgactgcagcattgctgagaacattgcctatggagacaacagccgggtggtgtcacaggaagagattgtgagggcagcaaaggaggccaacatacatgccttcatcgagtcactgcctaataaatatagcactaaagtaggagacaaaggaactcagctctctggtggccagaaacaacgcattgccatagctcgtgcccttgttagacagcctcatattttgcttttggatgaagccacgtcagctctggatacagaaagtgaaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtgaactctgactgtatgagatgttaaatactttttaatatttgtttagatatgacatttattcaaagttaaaagcaaacacttacagaattatgaagaggtatctgtttaacatttcctcagtcaagttcagagtcttcagagacttcgtaattaaaggaacagagtgagagacatcatcaagtggagagaaatcatagtttaaactgcattataaattttataacagaattaaagtagattttaaaagataaaatgtgtaattttgtttatattttcccatttggactgtaactgactgccttgctaaaagattatagaagtagcaaaaagtattgaaatgtttgcataaagtgtctataataaaactaaactttcatgtgactggagtcatcttgtccaaactgcctgtgaatatatcttctctcaattggaatattgtagataacttctgctttaaaaaagttttctttaaatatacctactcatttttgtgggaatggttaagcagtttaaataattcctgttgtatatgtctattcacattgggtcttacagaaccatctggcttcattcttcttggacttgatcctgctgattcttgcatttccacattaaggtggctctcaaacccaaaacacagatcgatataagattttaggaggtggggtgaggcacaattatgaagtgcatattattcagatgtatagtaaatactttgcattgcttttataaagggttctttaaggattttttaagatttttacacttccaaagtacatttactttttgtcttgataatgaatcacttttgccagtaattggcctcttccaaaagtgatccttctgacttacagatgtttaaaatgtgccatgagtttaactacatcttgatacaaacatgataaaaaaagaaaaaaatatattccaaaggttgggactctggacgacaaatttttttaaattagccaaaaagcattattaacattataaactatatttactataaacaattgctatcttaaataagcaacttctaaaaataaaaaaaagaagccatcacctccaggaaaaaaaaataggaaaggatataatcaggtaattctcaaagaagaaatgcatgagaaaaatgtatacagtttcaacaatcaaataaatgcaaattaaaacaaaatatcatttttttgccttgtaatttaatgatgaataaaaaaatctaatgtgacattc

SEQ ID NO: 732 - RNA, 5534 nt, Homo sapiens
  source 1..5534: mol_type = unassigned RNA; note = Homo sapiens ATP binding cassette subfamily B member 1 (ABCB1), transcript variant 3, mRNA, NCBI Reference Sequence: NM_000927.5
atcattactctttacctgtgaagagtagaacatgaagaaatctactttattcagatattctccagattcctaaagattagagatcatttctcattctcctaggagtactcacttcaggaagcaaccagataaaagagaggtgcaacggaagccagaacattcctcctggaaattcaacctgtttcgcagtttctcgaggaatcagcattcagtcaatccgggccgggagcagtcatctgtggtgaggctgattggctgggcaggaacagcgccggggcgtgggctgagcacagccgcttcgctctctttgccacaggaagcctgagctcattcgagtagcggctcttccaagctcaaagaagcagaggccgctgttcgtttcctttaggtctttccactaaagtcggagtatcttcttccaaaatttcacgtcttggtggccgttccaaggagcgcgaggtcggaatggatcttgaaggggaccgcaatggaggagcaaagaagaagaacttttttaaactgaacaataaaagtgaaaaagataagaaggaaaagaaaccaactgtcagtgtattttcaatgtttcgctattcaaattggcttgacaagttgtatatggtggtgggaactttggctgccatcatccatggggctggacttcctctcatgatgctggtgtttggagaaatgacagatatctttgcaaatgcaggaaatttagaagatctgatgtcaaacatcactaatagaagtgatatcaatgatacagggttcttcatgaatctggaggaagacatgaccaggtatgcctattattacagtggaattggtgctggggtgctggttgctgcttacattcaggtttcattttggtgcctggcagctggaagacaaatacacaaaattagaaaacagttttttcatgctataatgcgacaggagataggctggtttgatgtgcacgatgttggggagcttaacacccgacttacagatgatgtctccaagattaatgaaggaattggtgacaaaattggaatgttctttcagtcaatggcaacatttttcactgggtttatagtaggatttacacgtggttggaagctaacccttgtgattttggccatcagtcctgttcttggactgtcagctgctgtctgggcaaagatactatcttcatttactgataaagaactcttagcgtatgcaaaagctggagcagtagctgaagaggtcttggcagcaattagaactgtgattgcatttggaggacaaaagaaagaacttgaaaggtacaacaaaaatttagaagaagctaaaagaattgggataaagaaagctattacagccaatatttctataggtgctgctttcctgctgatctatgcatcttatgctctggccttctggtatgggaccaccttggtcctctcaggggaatattctattggacaagtactcactgtattcttttctgtattaattggggcttttagtgttggacaggcatctccaagcattgaagcatttgcaaatgcaagaggagcagcttatgaaatcttcaagataattgataataagccaagtattgacagctattcgaagagtgggcacaaaccagataatattaagggaaatttggaattcagaaatgttcacttcagttacccatctcgaaaagaagttaagatcttgaagggtctgaacctgaaggtgcagagtgggcagacggtggccctggttggaaacagtggctgtgggaagagcacaacagtccagctgatgcagaggctctatgaccccacagaggggatggtcagtgttgatggacaggatattaggaccataaatgtaaggtttctacgggaaatcattggtgtggtgagtcaggaacctgtattgtttgccaccacgatagctgaaaacattcgctatggccgtgaaaatgtcaccatggatgagattgagaaagctgtcaaggaagccaatgcctatgactttatcatgaaactgcctcataaatttgacaccctggttggagagagaggggcccagttgagtggtgggcagaagcagaggatcgccattgcacgtgccctggttcgcaaccccaagatcctcctgctggatgaggccacgtcagccttggacacagaaagcgaagcagtggttcaggtggctctggataaggccagaaaaggtcggaccaccattgtgatagctcatcgtttgtctacagttcgtaatgctgacgtcatcgctggtttcgatgatggagtcattgtggagaaaggaaatcatgatgaactcatgaaagagaaaggcatttacttcaaacttgtcacaatgcagacagcaggaaatgaagttgaattagaaaatgcagctgatgaatccaaaagtgaaattgatgccttggaaatgtcttcaaatgattcaagatccagtctaataagaaaaagatcaactcgtaggagtgtccgtggatcacaagcccaagacagaaagcttagtaccaaagaggctctggatgaaagtatacctccagtttccttttggaggattatgaagctaaatttaactgaatggccttattttgttgttggtgtattttgtgccattataaatggaggcctgcaaccagcatttgcaataatattttcaaagattataggggtttttacaagaattgatgatcctgaaacaaaacgacagaatagtaacttgttttcactattgtttctagcccttggaattatttcttttattacatttttccttcagggtttcacatttggcaaagctggagagatcctcaccaagcggctccgatacatggttttccgatccatgctcagacaggatgtgagttggtttgatgaccctaaaaacaccactggagcattgactaccaggctcgccaatgatgctgctcaagttaaaggggctataggttccaggcttgctgtaattacccagaatatagcaaatcttgggacaggaataattatatccttcatctatggttggcaactaacactgttactcttagcaattgtacccatcattgcaatagcaggagttgttgaaatgaaaatgttgtctggacaagcactgaaagataagaaagaactagaaggttctgggaagatcgctactgaagcaatagaaaacttccgaaccgttgtttctttgactcaggagcagaagtttgaacatatgtatgctcagagtttgcaggtaccatacagaaactctttgaggaaagcacacatctttggaattacattttccttcacccaggcaatgatgtatttttcctatgctggatgtttccggtttggagcctacttggtggcacataaactcatgagctttgaggatgttctgttagtattttcagctgttgtctttggtgccatggccgtggggcaagtcagttcatttgctcctgactatgccaaagccaaaatatcagcagcccacatcatcatgatcattgaaaaaacccctttgattgacagctacagcacggaaggcctaatgccgaacacattggaaggaaatgtcacatttggtgaagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttgatggcaaagaaataaagcgactgaatgttcagtggctccgagcacacctgggcatcgtgtcccaggagcccatcctgtttgactgcagcattgctgagaacattgcctatggagacaacagccgggtggtgtcacaggaagagattgtgagggcagcaaaggaggccaacatacatgccttcatcgagtcactgcctaataaatatagcactaaagtaggagacaaaggaactcagctctctggtggccagaaacaacgcattgccatagctcgtgcccttgttagacagcctcatattttgcttttggatgaagccacgtcagctctggatacagaaagtgaaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtgaactctgactgtatgagatgttaaatactttttaatatttgtttagatatgacatttattcaaagttaaaagcaaacacttacagaattatgaagaggtatctgtttaacatttcctcagtcaagttcagagtcttcagagacttcgtaattaaaggaacagagtgagagacatcatcaagtggagagaaatcatagtttaaactgcattataaattttataacagaattaaagtagattttaaaagataaaatgtgtaattttgtttatattttcccatttggactgtaactgactgccttgctaaaagattatagaagtagcaaaaagtattgaaatgtttgcataaagtgtctataataaaactaaactttcatgtgactggagtcatcttgtccaaactgcctgtgaatatatcttctctcaattggaatattgtagataacttctgctttaaaaaagttttctttaaatatacctactcatttttgtgggaatggttaagcagtttaaataattcctgttgtatatgtctattcacattgggtcttacagaaccatctggcttcattcttcttggacttgatcctgctgattcttgcatttccacattaaggtggctctcaaacccaaaacacagatcgatataagattttaggaggtggggtgaggcacaattatgaagtgcatattattcagatgtatagtaaatactttgcattgcttttataaagggttctttaaggattttttaagatttttacacttccaaagtacatttactttttgtcttgataatgaatcacttttgccagtaattggcctcttccaaaagtgatccttctgacttacagatgtttaaaatgtgccatgagtttaactacatcttgatacaaacatgataaaaaaagaaaaaaatatattccaaaggttgggactctggacgacaaatttttttaaattagccaaaaagcattattaacattataaactatatttactataaacaattgctatcttaaataagcaacttctaaaaataaaaaaaagaagccatcacctccaggaaaaaaaaataggaaaggatataatcaggtaattctcaaagaagaaatgcatgagaaaaatgtatacagtttcaacaatcaaataaatgcaaattaaaacaaaatatcatttttttgccttgtaatttaatgatgaataaaaaaatctaatgtgacattc

SEQ ID NO: 733 - RNA, 5387 nt, Homo sapiens
  source 1..5387: mol_type = unassigned RNA; note = Homo sapiens ATP binding cassette subfamily B member 1 (ABCB1), transcript variant 2, mRNA, NCBI Reference Sequence: NM_001348944.2
atcattactctttacctgtgaagagtagaacatgaagaaatctactttattcagatattctccagattcctaaagattagagatcatttctcattctcctaggagtactcacttcaggaagcaaccagataaaagagaggtgcaacggaagccagaacattcctcctggaaattcaacctgtttcgcagtttctcgaggaatcagcattcagtcaatccgggccgggagcagtcatctgtggtctttccactaaagtcggagtatcttcttccaaaatttcacgtcttggtggccgttccaaggagcgcgaggtcggaatggatcttgaaggggaccgcaatggaggagcaaagaagaagaacttttttaaactgaacaataaaagtgaaaaagataagaaggaaaagaaaccaactgtcagtgtattttcaatgtttcgctattcaaattggcttgacaagttgtatatggtggtgggaactttggctgccatcatccatggggctggacttcctctcatgatgctggtgtttggagaaatgacagatatctttgcaaatgcaggaaatttagaagatctgatgtcaaacatcactaatagaagtgatatcaatgatacagggttcttcatgaatctggaggaagacatgaccaggtatgcctattattacagtggaattggtgctggggtgctggttgctgcttacattcaggtttcattttggtgcctggcagctggaagacaaatacacaaaattagaaaacagttttttcatgctataatgcgacaggagataggctggtttgatgtgcacgatgttggggagcttaacacccgacttacagatgatgtctccaagattaatgaaggaattggtgacaaaattggaatgttctttcagtcaatggcaacatttttcactgggtttatagtaggatttacacgtggttggaagctaacccttgtgattttggccatcagtcctgttcttggactgtcagctgctgtctgggcaaagatactatcttcatttactgataaagaactcttagcgtatgcaaaagctggagcagtagctgaagaggtcttggcagcaattagaactgtgattgcatttggaggacaaaagaaagaacttgaaaggtacaacaaaaatttagaagaagctaaaagaattgggataaagaaagctattacagccaatatttctataggtgctgctttcctgctgatctatgcatcttatgctctggccttctggtatgggaccaccttggtcctctcaggggaatattctattggacaagtactcactgtattcttttctgtattaattggggcttttagtgttggacaggcatctccaagcattgaagcatttgcaaatgcaagaggagcagcttatgaaatcttcaagataattgataataagccaagtattgacagctattcgaagagtgggcacaaaccagataatattaagggaaatttggaattcagaaatgttcacttcagttacccatctcgaaaagaagttaagatcttgaagggtctgaacctgaaggtgcagagtgggcagacggtggccctggttggaaacagtggctgtgggaagagcacaacagtccagctgatgcagaggctctatgaccccacagaggggatggtcagtgttgatggacaggatattaggaccataaatgtaaggtttctacgggaaatcattggtgtggtgagtcaggaacctgtattgtttgccaccacgatagctgaaaacattcgctatggccgtgaaaatgtcaccatggatgagattgagaaagctgtcaaggaagccaatgcctatgactttatcatgaaactgcctcataaatttgacaccctggttggagagagaggggcccagttgagtggtgggcagaagcagaggatcgccattgcacgtgccctggttcgcaaccccaagatcctcctgctggatgaggccacgtcagccttggacacagaaagcgaagcagtggttcaggtggctctggataaggccagaaaaggtcggaccaccattgtgatagctcatcgtttgtctacagttcgtaatgctgacgtcatcgctggtttcgatgatggagtcattgtggagaaaggaaatcatgatgaactcatgaaagagaaaggcatttacttcaaacttgtcacaatgcagacagcaggaaatgaagttgaattagaaaatgcagctgatgaatccaaaagtgaaattgatgccttggaaatgtcttcaaatgattcaagatccagtctaataagaaaaagatcaactcgtaggagtgtccgtggatcacaagcccaagacagaaagcttagtaccaaagaggctctggatgaaagtatacctccagtttccttttggaggattatgaagctaaatttaactgaatggccttattttgttgttggtgtattttgtgccattataaatggaggcctgcaaccagcatttgcaataatattttcaaagattataggggtttttacaagaattgatgatcctgaaacaaaacgacagaatagtaacttgttttcactattgtttctagcccttggaattatttcttttattacatttttccttcagggtttcacatttggcaaagctggagagatcctcaccaagcggctccgatacatggttttccgatccatgctcagacaggatgtgagttggtttgatgaccctaaaaacaccactggagcattgactaccaggctcgccaatgatgctgctcaagttaaaggggctataggttccaggcttgctgtaattacccagaatatagcaaatcttgggacaggaataattatatccttcatctatggttggcaactaacactgttactcttagcaattgtacccatcattgcaatagcaggagttgttgaaatgaaaatgttgtctggacaagcactgaaagataagaaagaactagaaggttctgggaagatcgctactgaagcaatagaaaacttccgaaccgttgtttctttgactcaggagcagaagtttgaacatatgtatgctcagagtttgcaggtaccatacagaaactctttgaggaaagcacacatctttggaattacattttccttcacccaggcaatgatgtatttttcctatgctggatgtttccggtttggagcctacttggtggcacataaactcatgagctttgaggatgttctgttagtattttcagctgttgtctttggtgccatggccgtggggcaagtcagttcatttgctcctgactatgccaaagccaaaatatcagcagcccacatcatcatgatcattgaaaaaacccctttgattgacagctacagcacggaaggcctaatgccgaacacattggaaggaaatgtcacatttggtgaagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttgatggcaaagaaataaagcgactgaatgttcagtggctccgagcacacctgggcatcgtgtcccaggagcccatcctgtttgactgcagcattgctgagaacattgcctatggagacaacagccgggtggtgtcacaggaagagattgtgagggcagcaaaggaggccaacatacatgccttcatcgagtcactgcctaataaatatagcactaaagtaggagacaaaggaactcagctctctggtggccagaaacaacgcattgccatagctcgtgcccttgttagacagcctcatattttgcttttggatgaagccacgtcagctctggatacagaaagtgaaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtgaactctgactgtatgagatgttaaatactttttaatatttgtttagatatgacatttattcaaagttaaaagcaaacacttacagaattatgaagaggtatctgtttaacatttcctcagtcaagttcagagtcttcagagacttcgtaattaaaggaacagagtgagagacatcatcaagtggagagaaatcatagtttaaactgcattataaattttataacagaattaaagtagattttaaaagataaaatgtgtaattttgtttatattttcccatttggactgtaactgactgccttgctaaaagattatagaagtagcaaaaagtattgaaatgtttgcataaagtgtctataataaaactaaactttcatgtgactggagtcatcttgtccaaactgcctgtgaatatatcttctctcaattggaatattgtagataacttctgctttaaaaaagttttctttaaatatacctactcatttttgtgggaatggttaagcagtttaaataattcctgttgtatatgtctattcacattgggtcttacagaaccatctggcttcattcttcttggacttgatcctgctgattcttgcatttccacattaaggtggctctcaaacccaaaacacagatcgatataagattttaggaggtggggtgaggcacaattatgaagtgcatattattcagatgtatagtaaatactttgcattgcttttataaagggttctttaaggattttttaagatttttacacttccaaagtacatttactttttgtcttgataatgaatcacttttgccagtaattggcctcttccaaaagtgatccttctgacttacagatgtttaaaatgtgccatgagtttaactacatcttgatacaaacatgataaaaaaagaaaaaaatatattccaaaggttgggactctggacgacaaatttttttaaattagccaaaaagcattattaacattataaactatatttactataaacaattgctatcttaaataagcaacttctaaaaataaaaaaaagaagccatcacctccaggaaaaaaaaataggaaaggatataatcaggtaattctcaaagaagaaatgcatgagaaaaatgtatacagtttcaacaatcaaataaatgcaaattaaaacaaaatatcatttttttgccttgtaatttaatgatgaataaaaaaatctaatgtgacattc

SEQ ID NO: 734 - RNA, 5586 nt, Homo sapiens
  source 1..5586: mol_type = unassigned RNA; note = Homo sapiens ATP binding cassette subfamily B member 1 (ABCB1), transcript variant 1, mRNA, NCBI Reference Sequence: NM_001348945.2
atcattactctttacctgtgaagagtagaacatgaagaaatctactttattcagatattctccagattcctaaagattagagatcatttctcattctcctaggagtactcacttcaggaagcaaccagataaaagatcaaaactcactaaatgatacatatagaacagactgcagcagagaggcaaatctttaatgttgtcagagtatagacaagttggtgaaatggctacatgagagcggaggacaagaaggtgcagattgtggcagtcacttcaaatggaaatatcaccgcttgaatgaaggtatatgagtgtcaacttgcaaggggaccagagaggtgcaacggaagccagaacattcctcctggaaattcaacctgtttcgcagtttctcgaggaatcagcattcagtcaatccgggccgggagcagtcatctgtggtctttccactaaagtcggagtatcttcttccaaaatttcacgtcttggtggccgttccaaggagcgcgaggtcggaatggatcttgaaggggaccgcaatggaggagcaaagaagaagaacttttttaaactgaacaataaaagtgaaaaagataagaaggaaaagaaaccaactgtcagtgtattttcaatgtttcgctattcaaattggcttgacaagttgtatatggtggtgggaactttggctgccatcatccatggggctggacttcctctcatgatgctggtgtttggagaaatgacagatatctttgcaaatgcaggaaatttagaagatctgatgtcaaacatcactaatagaagtgatatcaatgatacagggttcttcatgaatctggaggaagacatgaccaggtatgcctattattacagtggaattggtgctggggtgctggttgctgcttacattcaggtttcattttggtgcctggcagctggaagacaaatacacaaaattagaaaacagttttttcatgctataatgcgacaggagataggctggtttgatgtgcacgatgttggggagcttaacacccgacttacagatgatgtctccaagattaatgaaggaattggtgacaaaattggaatgttctttcagtcaatggcaacatttttcactgggtttatagtaggatttacacgtggttggaagctaacccttgtgattttggccatcagtcctgttcttggactgtcagctgctgtctgggcaaagatactatcttcatttactgataaagaactcttagcgtatgcaaaagctggagcagtagctgaagaggtcttggcagcaattagaactgtgattgcatttggaggacaaaagaaagaacttgaaaggtacaacaaaaatttagaagaagctaaaagaattgggataaagaaagctattacagccaatatttctataggtgctgctttcctgctgatctatgcatcttatgctctggccttctggtatgggaccaccttggtcctctcaggggaatattctattggacaagtactcactgtattcttttctgtattaattggggcttttagtgttggacaggcatctccaagcattgaagcatttgcaaatgcaagaggagcagcttatgaaatcttcaagataattgataataagccaagtattgacagctattcgaagagtgggcacaaaccagataatattaagggaaatttggaattcagaaatgttcacttcagttacccatctcgaaaagaagttaagatcttgaagggtctgaacctgaaggtgcagagtgggcagacggtggccctggttggaaacagtggctgtgggaagagcacaacagtccagctgatgcagaggctctatgaccccacagaggggatggtcagtgttgatggacaggatattaggaccataaatgtaaggtttctacgggaaatcattggtgtggtgagtcaggaacctgtattgtttgccaccacgatagctgaaaacattcgctatggccgtgaaaatgtcaccatggatgagattgagaaagctgtcaaggaagccaatgcctatgactttatcatgaaactgcctcataaatttgacaccctggttggagagagaggggcccagttgagtggtgggcagaagcagaggatcgccattgcacgtgccctggttcgcaaccccaagatcctcctgctggatgaggccacgtcagccttggacacagaaagcgaagcagtggttcaggtggctctggataaggccagaaaaggtcggaccaccattgtgatagctcatcgtttgtctacagttcgtaatgctgacgtcatcgctggtttcgatgatggagtcattgtggagaaaggaaatcatgatgaactcatgaaagagaaaggcatttacttcaaacttgtcacaatgcagacagcaggaaatgaagttgaattagaaaatgcagctgatgaatccaaaagtgaaattgatgccttggaaatgtcttcaaatgattcaagatccagtctaataagaaaaagatcaactcgtaggagtgtccgtggatcacaagcccaagacagaaagcttagtaccaaagaggctctggatgaaagtatacctccagtttccttttggaggattatgaagctaaatttaactgaatggccttattttgttgttggtgtattttgtgccattataaatggaggcctgcaaccagcatttgcaataatattttcaaagattataggggtttttacaagaattgatgatcctgaaacaaaacgacagaatagtaacttgttttcactattgtttctagcccttggaattatttcttttattacatttttccttcagggtttcacatttggcaaagctggagagatcctcaccaagcggctccgatacatggttttccgatccatgctcagacaggatgtgagttggtttgatgaccctaaaaacaccactggagcattgactaccaggctcgccaatgatgctgctcaagttaaaggggctataggttccaggcttgctgtaattacccagaatatagcaaatcttgggacaggaataattatatccttcatctatggttggcaactaacactgttactcttagcaattgtacccatcattgcaatagcaggagttgttgaaatgaaaatgttgtctggacaagcactgaaagataagaaagaactagaaggttctgggaagatcgctactgaagcaatagaaaacttccgaaccgttgtttctttgactcaggagcagaagtttgaacatatgtatgctcagagtttgcaggtaccatacagaaactctttgaggaaagcacacatctttggaattacattttccttcacccaggcaatgatgtatttttcctatgctggatgtttccggtttggagcctacttggtggcacataaactcatgagctttgaggatgttctgttagtattttcagctgttgtctttggtgccatggccgtggggcaagtcagttcatttgctcctgactatgccaaagccaaaatatcagcagcccacatcatcatgatcattgaaaaaacccctttgattgacagctacagcacggaaggcctaatgccgaacacattggaaggaaatgtcacatttggtgaagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttgatggcaaagaaataaagcgactgaatgttcagtggctccgagcacacctgggcatcgtgtcccaggagcccatcctgtttgactgcagcattgctgagaacattgcctatggagacaacagccgggtggtgtcacaggaagagattgtgagggcagcaaaggaggccaacatacatgccttcatcgagtcactgcctaataaatatagcactaaagtaggagacaaaggaactcagctctctggtggccagaaacaacgcattgccatagctcgtgcccttgttagacagcctcatattttgcttttggatgaagccacgtcagctctggatacagaaagtgaaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtgaactctgactgtatgagatgttaaatactttttaatatttgtttagatatgacatttattcaaagttaaaagcaaacacttacagaattatgaagaggtatctgtttaacatttcctcagtcaagttcagagtcttcagagacttcgtaattaaaggaacagagtgagagacatcatcaagtggagagaaatcatagtttaaactgcattataaattttataacagaattaaagtagattttaaaagataaaatgtgtaattttgtttatattttcccatttggactgtaactgactgccttgctaaaagattatagaagtagcaaaaagtattgaaatgtttgcataaagtgtctataataaaactaaactttcatgtgactggagtcatcttgtccaaactgcctgtgaatatatcttctctcaattggaatattgtagataacttctgctttaaaaaagttttctttaaatatacctactcatttttgtgggaatggttaagcagtttaaataattcctgttgtatatgtctattcacattgggtcttacagaaccatctggcttcattcttcttggacttgatcctgctgattcttgcatttccacattaaggtggctctcaaacccaaaacacagatcgatataagattttaggaggtggggtgaggcacaattatgaagtgcatattattcagatgtatagtaaatactttgcattgcttttataaagggttctttaaggattttttaagatttttacacttccaaagtacatttactttttgtcttgataatgaatcacttttgccagtaattggcctcttccaaaagtgatccttctgacttacagatgtttaaaatgtgccatgagtttaactacatcttgatacaaacatgataaaaaaagaaaaaaatatattccaaaggttgggactctggacgacaaatttttttaaattagccaaaaagcattattaacattataaactatatttactataaacaattgctatcttaaataagcaacttctaaaaataaaaaaaagaagccatcacctccaggaaaaaaaaataggaaaggatataatcaggtaattctcaaagaagaaatgcatgagaaaaatgtatacagtttcaacaatcaaataaatgcaaattaaaacaaaatatcatttttttgccttgtaatttaatgatgaataaaaaaatctaatgtgacattc

SEQ ID NO: 735 - RNA, 1812 nt, Homo sapiens
  source 1..1812: mol_type = unassigned RNA; note = Homo sapiens actin beta (ACTB), mRNA, NCBI Reference Sequence: NM_001101.5
accgccgagaccgcgtccgccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaatga

SEQ ID NO: 736 - RNA, 3301 nt, Homo sapiens
  source 1..3301: mol_type = unassigned RNA; note = Homo sapiens periostin (POSTN), transcript variant 1, mRNA, NCBI Reference Sequence: NM_006475.3
gccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatacaactaaaattataaccaaagttgtggaaccaaaaattaaagtgattgaaggcagtcttcagcctattatcaaaactgaaggacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgaaa

SEQ ID NO: 737 - RNA, 3130 nt, Homo sapiens
  source 1..3130: mol_type = unassigned RNA; note = Homo sapiens periostin (POSTN), transcript variant 2, mRNA, NCBI Reference Sequence: NM_001135934.2
gccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctataagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgaaa

SEQ ID NO: 738 - RNA, 3136 nt, Homo sapiens
  source 1..3136: mol_type = unassigned RNA; note = Homo sapiens periostin (POSTN), transcript variant 3, mRNA, NCBI Reference Sequence: NM_001135935.2
gccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgaaa

SEQ ID NO: 739 - RNA, 3046 nt, Homo sapiens
  source 1..3046: mol_type = unassigned RNA; note = Homo sapiens periostin (POSTN), transcript variant 4, mRNA, NCBI Reference Sequence: NM_001135936.2
gccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctataagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgaaa

SEQ ID NO: 740 - RNA, 3220 nt, Homo sapiens
  source 1..3220: mol_type = unassigned RNA; note = Homo sapiens periostin (POSTN), transcript variant 5, mRNA, NCBI Reference Sequence: NM_001286665.2
gccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgaaa

SEQ ID NO: 741 - RNA, 3040 nt, Homo sapiens
  source 1..3040: mol_type = unassigned RNA; note = Homo sapiens periostin (POSTN), transcript variant 6, mRNANCBI Reference Sequence: NM_001286666.2
gccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgaaa

SEQ ID NO: 742 - RNA, 2956 nt, Homo sapiens
  source 1..2956: mol_type = unassigned RNA; note = Homo sapiens periostin (POSTN), transcript variant 7, mRNA, NCBI Reference Sequence: NM_001286667.2
gccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgaaa

SEQ ID NO: 743 - RNA, 3217 nt, Homo sapiens
  source 1..3217: mol_type = unassigned RNA; note = Homo sapiens periostin (POSTN), transcript variant 8, mRNA, NCBI Reference Sequence: NM_001330517.2
gccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatacaactaaaattataaccaaagttgtggaaccaaaaattaaagtgattgaaggcagtcttcagcctattatcaaaactgaaggacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgaaa

SEQ ID NO: 744 - RNA, 3282 nt, Homo sapiens
  source 1..3282: mol_type = unassigned RNA; note = Homo sapiens periostin (POSTN), transcript variant X3, mRNA, NCBI Reference Sequence: XM_005266232.2
ctcaggttgatgcagtgttccctcccacaactctgacatgtatataaattctgagctctccaaagcccactgccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatacaactaaaattataaccaaagttgtggaaccaaaaattaaagtgattgaaggcagtcttcagcctattatcaaaactgaagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgaaa

SEQ ID NO: 745 - RNA, 2582 nt, Homo sapiens
  source 1..2582: mol_type = unassigned RNA; note = Homo sapiens periostin (POSTN), transcript variant X1, mRNA, NCBI Reference Sequence: XM_017020355.1
ctcaggttgatgcagtgttccctcccacaactctgacatgtatataaattctgagctctccaaagcccactgccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatacaactaaaattataaccaaagttgtggaaccaaaaattaaagtgattgaaggcagtcttcagcctattatcaaaactgaaggacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagccataattgcgaagtatttctaactacaacaatttaat

SEQ ID NO: 746 - RNA, 3363 nt, Homo sapiens
  source 1..3363: mol_type = unassigned RNA; note = Homo sapiens periostin (POSTN), transcript variant X2, mRNA, NCBI Reference Sequence: XM_017020356.1
ctcaggttgatgcagtgttccctcccacaactctgacatgtatataaattctgagctctccaaagcccactgccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatacaactaaaattataaccaaagttgtggaaccaaaaattaaagtgattgaaggcagtcttcagcctattatcaaaactgaaggacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagcgaattgaaaacatgtatataatagaaaaaactggacttcatgctgagtatagatgatacatataaaagaagtcaaaatttggagaaaaaatttaaaaagataagtagaaaaatgaagtaactgtagaaaccatacttactctttgatctcaaatgcccaaaaactgaatgaaaatgtgaatttaggccgaccaggtagtcttgtcaataaactaaaagaaaaacaggaaaattgagaaatatgttacaactataacaacacaaaacagcatagttttgaaacacttgcagttcttaaatataaaagcttttattagttaattttttaaaaggatctcataggattgacactgaatcaggttgggaggtggaacaagggtgatggcatattctttctgaattacttattataacatttctagaatcattaggtcagtgctactttgttgtcgtcaatgtacaataaaggaatcacaaattgatcttagtgataattttacagaggcagacattgcacataggtatgactgcaaaaatgggtggctaactctgggaagatacttgtgttaaactttatatgacatttaataacccttcatcataaggcaatgttttttacaaaaagattgaaaaaatcatgtaagtcatttactctgcaaaaatggcacattaggtggggttccaaaatccataatgaaacaatgtgttttgcaactaagaaacattcattatgatatatggaaaacactgtctgtctacttgtcctttacgaaaaaatgtaaaactctgaggatcataaaatttaactactaaaaataa

SEQ ID NO: 747 - RNA, 5016 nt, Homo sapiens
  source 1..5016: mol_type = unassigned RNA; note = Homo sapiens kinesin family member 11 (KIF11), mRNA, NCBI Reference Sequence: NM_004523.4
agtttctggggattcgggcggagacgagattagtgatttggcggctccgactggcgcgggacaaacgccacggccagagtaccgggtagagagcggggacgccgacctgcgtgcgtcggtcctccaggccacgccagcgcccgagagggaccagggagactccggcccctgtcggccgccaagcccctccgcccctcacagcgcccaggtccgcggccgggccttgattttttggcggggaccgtcatggcgtcgcagccaaattcgtctgcgaagaagaaagaggagaaggggaagaacatccaggtggtggtgagatgcagaccatttaatttggcagagcggaaagctagcgcccattcaatagtagaatgtgatcctgtacgaaaagaagttagtgtacgaactggaggattggctgacaagagctcaaggaaaacatacacttttgatatggtgtttggagcatctactaaacagattgatgtttaccgaagtgttgtttgtccaattctggatgaagttattatgggctataattgcactatctttgcgtatggccaaactggcactggaaaaacttttacaatggaaggtgaaaggtcacctaatgaagagtatacctgggaagaggatcccttggctggtataattccacgtacccttcatcaaatttttgagaaacttactgataatggtactgaattttcagtcaaagtgtctctgttggagatctataatgaagagctttttgatcttcttaatccatcatctgatgtttctgagagactacagatgtttgatgatccccgtaacaagagaggagtgataattaaaggtttagaagaaattacagtacacaacaaggatgaagtctatcaaattttagaaaagggggcagcaaaaaggacaactgcagctactctgatgaatgcatactctagtcgttcccactcagttttctctgttacaatacatatgaaagaaactacgattgatggagaagagcttgttaaaatcggaaagttgaacttggttgatcttgcaggaagtgaaaacattggccgttctggagctgttgataagagagctcgggaagctggaaatataaatcaatccctgttgactttgggaagggtcattactgcccttgtagaaagaacacctcatgttccttatcgagaatctaaactaactagaatcctccaggattctcttggagggcgtacaagaacatctataattgcaacaatttctcctgcatctctcaatcttgaggaaactctgagtacattggaatatgctcatagagcaaagaacatattgaataagcctgaagtgaatcagaaactcaccaaaaaagctcttattaaggagtatacggaggagatagaacgtttaaaacgagatcttgctgcagcccgtgagaaaaatggagtgtatatttctgaagaaaattttagagtcatgagtggaaaattaactgttcaagaagagcagattgtagaattgattgaaaaaattggtgctgttgaggaggagctgaatagggttacagagttgtttatggataataaaaatgaacttgaccagtgtaaatctgacctgcaaaataaaacacaagaacttgaaaccactcaaaaacatttgcaagaaactaaattacaacttgttaaagaagaatatatcacatcagctttggaaagtactgaggagaaacttcatgatgctgccagcaagctgcttaacacagttgaagaaactacaaaagatgtatctggtctccattccaaactggatcgtaagaaggcagttgaccaacacaatgcagaagctcaggatatttttggcaaaaacctgaatagtctgtttaataatatggaagaattaattaaggatggcagctcaaagcaaaaggccatgctagaagtacataagaccttatttggtaatctgctgtcttccagtgtctctgcattagataccattactacagtagcacttggatctctcacatctattccagaaaatgtgtctactcatgtttctcagatttttaatatgatactaaaagaacaatcattagcagcagaaagtaaaactgtactacaggaattgattaatgtactcaagactgatcttctaagttcactggaaatgattttatccccaactgtggtgtctatactgaaaatcaatagtcaactaaagcatattttcaagacttcattgacagtggccgataagatagaagatcaaaaaaaggaactagatggctttctcagtatactgtgtaacaatctacatgaactacaagaaaataccatttgttccttggttgagtcacaaaagcaatgtggaaacctaactgaagacctgaagacaataaagcagacccattcccaggaactttgcaagttaatgaatctttggacagagagattctgtgctttggaggaaaagtgtgaaaatatacagaaaccacttagtagtgtccaggaaaatatacagcagaaatctaaggatatagtcaacaaaatgacttttcacagtcaaaaattttgtgctgattctgatggcttctcacaggaactcagaaattttaaccaagaaggtacaaaattggttgaagaatctgtgaaacactctgataaactcaatggcaacctggaaaaaatatctcaagagactgaacagagatgtgaatctctgaacacaagaacagtttatttttctgaacagtgggtatcttccttaaatgaaagggaacaggaacttcacaacttattggaggttgtaagccaatgttgtgaggcttcaagttcagacatcactgagaaatcagatggacgtaaggcagctcatgagaaacagcataacatttttcttgatcagatgactattgatgaagataaattgatagcacaaaatctagaacttaatgaaaccataaaaattggtttgactaagcttaattgctttctggaacaggatctgaaactggatatcccaacaggtacgacaccacagaggaaaagttatttatacccatcaacactggtaagaactgaaccacgtgaacatctccttgatcagctgaaaaggaaacagcctgagctgttaatgatgctaaactgttcagaaaacaacaaagaagagacaattccggatgtggatgtagaagaggcagttctggggcagtatactgaagaacctctaagtcaagagccatctgtagatgctggtgtggattgttcatcaattggcggggttccatttttccagcataaaaaatcacatggaaaagacaaagaaaacagaggcattaacacactggagaggtctaaagtggaagaaactacagagcacttggttacaaagagcagattacctctgcgagcccagatcaacctttaattcacttgggggttggcaattttatttttaaagaaaacttaaaaataaaacctgaaaccccagaacttgagccttgtgtatagattttaaaagaatatatatatcagccgggcgcggtggctcatgcctgtaatcccagcactttgggaggctgaggcgggtggattgcttgagcccaggagtttgagaccagcctggccaacgtggcaaaacctcgtctctgttaaaaattagccgggcgtggtggcacactcctgtaatcccagctactggggaggctgaggcacgagaatcacttgaacccaggaagcggggttgcagtgagccaaaggtacaccactacactccagcctgggcaacagagcaagactcggtctcaaaaacaaaatttaaaaaagatataaggcagtactgtaaattcagttgaattttgatatctacccatttttctgtcatccctatagttcactttgtattaaattgggtttcatttgggatttgcaatgtaaatacgtatttctagttttcatataaagtagttcttttataacaaatgaaaagtatttttcttgtatattattaagtaatgaatatataagaactgtactcttctcagcttgagcttacataggtaaatatcaccaacatctgtccttagaaaggaccatctcatgttttttttcttgctatgacttgtgtattttcttgcatcctccctagacttccctatttcgctttctcctcggctcactttctccctttttatttttcaccaaaccatttgtagagctacaaaaggtatcctttcttattttcagtagtcagaattttatctagaaatcttttaacacctttttagtggttatttctaaaatcactgtcaacaataaatctaaccctagttgtatccctcctttcagtatttttcacttgttgccccaaatgtgaaagcatttcattcctttaagaggcctaactcattcaccctgacagagttcacaaaaagcccacttaagagtatacattgctattatgggagaccacccagacatctgactaatggctctgtgcccacactccaagacctgtgccttttagagaagctcacaatgatttaaggactgtttgaaacttccaattatgtctataatttatattcttttgtttacatgatgaaactttttgttgttgcttgtttgtatataatacaatgtgtacatgtatctttttctcgattcaaatcttaacccttaggactctggtatttttgatctggcaaccatatttctggaagttgagatgtttcagcttgaagaaccaaaacagaaggaatatgtacaaagaataaattttctgctcacgatgagtttagtgtgtaaagtttagagacatctgactttgatagctaaattaaaccaaaccctattgaagaattgaatatatgctacttcaagaaactaaattgatctcgtagaattatcttaataaaataatggctataatttctctgcaaaatcagatgtcagcataagcgatggataatacctaataaactgccctcagtaaatccatggttaataaatgtggtttctacattaa

SEQ ID NO: 748 - RNA, 3339 nt, Homo sapiens
  source 1..3339: mol_type = unassigned RNA; note = Homo sapiens angiotensin converting enzyme 2 (ACE2), transcript variant 1, mRNA, NCBI Reference Sequence: NM_001371415.1
agtctagggaaagtcattcagtggatgtgatcttggctcacaggggacgatgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttagaaaaatctatgtttttcctcttgaggtgattttgttgtatgtaaatgttaatttcatggtatagaaaatataagatgataaagatatcattaaatgtcaaaactatgactctgttcagaaaaaaaattgtccaaagacaacatggccaaggagagagcatcttcattgacattgctttcagtatttatttctgtctctggatttgacttctgttctgtttcttaataaggattttgtattagagtatattagggaaagtgtgtatttggtctcacaggctgttcagggataatctaaatgtaaatgtctgttgaatttctgaagttgaaaacaaggatatatcattggagcaagtgttggatcttgtatggaatatggatggatcacttgtaaggacagtgcctgggaactggtgtagctgcaaggattgagaatggcatgcattagctcactttcatttaatccattgtcaaggatgacatgctttcttcacagtaactcagttcaagtactatggtgatttgcctacagtgatgtttggaatcgatcatgctttcttcaaggtgacaggtctaaagagagaagaatccagggaacaggtagaggacattgctttttcacttccaaggtgcttgatcaacatctccctgacaacacaaaactagagccaggggcctccgtgaactcccagagcatgcctgatagaaactcatttctactgttctctaactgtggagtgaatggaaattccaactgtatgttcaccctctgaagtgggtacccagtctcttaaatcttttgtatttgctcacagtgtttgagcagtgctgagcacaaagcagacactcaataaatgctagatttacacactc

SEQ ID NO: 749 - RNA, 3596 nt, Homo sapiens
  source 1..3596: mol_type = unassigned RNA; note = Homo sapiens angiotensin converting enzyme 2 (ACE2), transcript variant 2, mRNA, NCBI Reference Sequence: NM_021804.3
ggcactcatacatacactctggcaatgaggacactgagctcgcttctgaaatttgacaagataaccactaaaatctctttgaattctatgttgttgtgatcccatggctacagaggatcaggagttgacatagatactctttggatttcataccatgtggaggctttcttacttccacgtgaccttgactgagttttgaatagcgcccaacccaagttcaaaggctgataagagagaaaatctcatgaggaggttttagtctagggaaagtcattcagtggatgtgatcttggctcacaggggacgatgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttagaaaaatctatgtttttcctcttgaggtgattttgttgtatgtaaatgttaatttcatggtatagaaaatataagatgataaagatatcattaaatgtcaaaactatgactctgttcagaaaaaaaattgtccaaagacaacatggccaaggagagagcatcttcattgacattgctttcagtatttatttctgtctctggatttgacttctgttctgtttcttaataaggattttgtattagagtatattagggaaagtgtgtatttggtctcacaggctgttcagggataatctaaatgtaaatgtctgttgaatttctgaagttgaaaacaaggatatatcattggagcaagtgttggatcttgtatggaatatggatggatcacttgtaaggacagtgcctgggaactggtgtagctgcaaggattgagaatggcatgcattagctcactttcatttaatccattgtcaaggatgacatgctttcttcacagtaactcagttcaagtactatggtgatttgcctacagtgatgtttggaatcgatcatgctttcttcaaggtgacaggtctaaagagagaagaatccagggaacaggtagaggacattgctttttcacttccaaggtgcttgatcaacatctccctgacaacacaaaactagagccaggggcctccgtgaactcccagagcatgcctgatagaaactcatttctactgttctctaactgtggagtgaatggaaattccaactgtatgttcaccctctgaagtgggtacccagtctcttaaatcttttgtatttgctcacagtgtttgagcagtgctgagcacaaagcagacactcaataaatgctagatttacacactc

SEQ ID NO: 750 - RNA, 3141 nt, Homo sapiens
  source 1..3141: mol_type = unassigned RNA; note = Homo sapiens angiotensin converting enzyme 2 (ACE2), transcript variant 3, mRNA, NCBI Reference Sequence: NM_001386259.1
agtctagggaaagtcattcagtggatgtgatcttggctcacaggggacgatgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagccaactccactcttgggaaaaagttggctgacagccatcttgaaagattgagggctgaaaatccaagaactgaggatcaagatctctcccctgtcataaaactacatatggatctgcccttcagtaggaaattcctaaaagtctcccatgagataaagaatcagtgctggaaaactcactccgataccaccaccaccaaatcatgatagaaacagctatgtgtgtctttttttaattagacctcatcttccttggaactaactctgaaagggccatgaatctcagcccccccaaaatccctccccaaaagcatgctgccaggtgatgcaggcccaagctaggtgacagatgtttaacttggaatgatgtttgcagtcatgtgataataacattggatggaacaattcagaggctgttcttatgattacaagtaatggggacatttttatcatttgagaatgactgcaaaactatggaatttggcaaagactttatttggaagcagggaagaaagcccactgaatagctttgaagggataatggagggaaagaattatgttgttttctgcttttgtcctatagagtttcatttcaacaccaggatacttccacaaagcagtcttggccatgttgatggtaaggaaagaatgacagctaataacagctgcctgttatgtgtgatgccatcttaaggacatctcccgcatgcacccattttttctttttttttttttggtgactatttatgggcttactggctaggaaaagacacaacaatgaaa

SEQ ID NO: 751 - RNA, 3006 nt, Homo sapiens
  source 1..3006: mol_type = unassigned RNA; note = Homo sapiens angiotensin converting enzyme 2 (ACE2), transcript variant 4, mRNA, NCBI Reference Sequence: NM_001386260.1
agtctagggaaagtcattcagtggatgtgatcttggctcacaggggacgatgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttagaaaaatctatgtttttcctcttgaggtgattttgttgtatgtaaatgttaatttcatggtatagaaaatataagatgataaagatatcattaaatgtcaaaactatgactctgttcagaaaaaaaattgtccaaagacaacatggccaaggagagagcatcttcattgacattgctttcagtatttatttctgtctctggatttgacttctgttctgtttcttaataaggattttgtattagagtatattagggaaagtgtgtatttggtctcacaggctgttcagggataatctaaatgtaaatgtctgttgaatttctgaagttgaaaacaaggatatatcattggagcaagtgttggatcttgtatggaatatggatggatcacttgtaaggacagtgcctgggaactggtgtagctgcaaggattgagaatggcatgcattagctcactttcatttaatccattgtcaaggatgacatgctttcttcacagtaactcagttcaagtactatggtgatttgcctacagtgatgtttggaatcgatcatgctttcttcaaggtgacaggtctaaagagagaagaatccagggaacaggtagaggacattgctttttcacttccaaggtgcttgatcaacatctccctgacaacacaaaactagagccaggggcctccgtgaactcccagagcatgcctgatagaaactcatttctactgttctctaactgtggagtgaatggaaattccaactgtatgttcaccctctgaagtgggtacccagtctcttaaatcttttgtatttgctcacagtgtttgagcagtgctgagcacaaagcagacactcaataaatgctagatttacacactc

SEQ ID NO: 752 - RNA, 2360 nt, Homo sapiens
  source 1..2360: mol_type = unassigned RNA; note = Homo sapiens angiotensin converting enzyme 2 (ACE2), transcript variant 5, mRNA, NCBI Reference Sequence: NM_001388452.1
gtaattcccaggttgcaggcttgtgagagccttaggttggattccctagcttgaaaaggagatcgttttacaagtgcttcattgaggagagctctgaggcagaggggaatgagggaagcaggctgggacaaaggagggaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttagaaaaatctatgtttttcctcttgaggtgattttgttgtatgtaaatgttaatttcatggtatagaaaatataagatgataaagatatcattaaatgtcaaaactatgactctgttcagaaaaaaaattgtccaaagacaacatggccaaggagagagcatcttcattgacattgctttcagtatttatttctgtctctggatttgacttctgttctgtttcttaataaggattttgtattagagtatattagggaaagtgtgtatttggtctcacaggctgttcagggataatctaaatgtaaatgtctgttgaatttctgaagttgaaaacaaggatatatcattggagcaagtgttggatcttgtatggaatatggatggatcacttgtaaggacagtgcctgggaactggtgtagctgcaaggattgagaatggcatgcattagctcactttcatttaatccattgtcaaggatgacatgctttcttcacagtaactcagttcaagtactatggtgatttgcctacagtgatgtttggaatcgatcatgctttcttcaaggtgacaggtctaaagagagaagaatccagggaacaggtagaggacattgctttttcacttccaaggtgcttgatcaacatctccctgacaacacaaaactagagccaggggcctccgtgaactcccagagcatgcctgatagaaactcatttctactgttctctaactgtggagtgaatggaaattccaactgtatgttcaccctctgaagtgggtacccagtctcttaaatcttttgtatttgctcacagtgtttgagcagtgctgagcacaaagcagacactcaataaatgctagatttacacactc

SEQ ID NO: 753 - RNA, 3135 nt, Homo sapiens
  source 1..3135: mol_type = unassigned RNA; note = Homo sapiens angiotensin converting enzyme 2 (ACE2), transcript variant 6, mRNA, NCBI Reference Sequence: NM_001389402.1
ttagaactttttaaaagaggcaaaggcagaggagaacaaaggaaggaggaagtaacttgtggaatgttgagaaagcgcccaacccaagttcaaaggctgataagagagaaaatctcatgaggaggttttagtctagggaaagtcattcagtggatgtgatcttggctcacaggggacgatgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttagaaaaatctatgtttttcctcttgaggtgattttgttgtatgtaaatgttaatttcatggtatagaaaatataagatgataaagatatcattaaatgtcaaaactatgactctgttcagaaaaaaaattgtccaaagacaacatggccaaggagagagcatcttcattgacattgctttcagtatttatttctgtctctggatttgacttctgttctgtttcttaataaggattttgtattagagtatattagggaaagtgtgtatttggtctcacaggctgttcagggataatctaaatgtaaatgtctgttgaatttctgaagttgaaaacaaggatatatcattggagcaagtgttggatcttgtatggaatatggatggatcacttgtaaggacagtgcctgggaactggtgtagctgcaaggattgagaatggcatgcattagctcactttcatttaatccattgtcaaggatgacatgctttcttcacagtaactcagttcaagtactatggtgatttgcctacagtgatgtttggaatcgatcatgctttcttcaaggtgacaggtctaaagagagaagaatccagggaacaggtagaggacattgctttttcacttccaaggtgcttgatcaacatctccctgacaacacaaaactagagccaggggcctccgtgaactcccagagcatgcctgatagaaactcatttctactgttctctaactgtggagtgaatggaaattccaactgtatgttcaccctctgaagtgggtacccagtctcttaaatcttttgtatttgctcacagtgtttgagcagtgctgagcacaaagcagacactcaataaatgctagatttacacactc

SEQ ID NO: 754 - RNA, 3358 nt, Homo sapiens
  source 1..3358: mol_type = unassigned RNA; note = Homo sapiens C-C motif chemokine receptor 5 (CCR5), transcript variant C, mRNA, NCBI Reference Sequence: NM_001394783.1
agaagagctgagacatccgttcccctacaagaaactctccccgggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttgggttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatagaggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctgtctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataa

SEQ ID NO: 755 - RNA, 3661 nt, Homo sapiens
  source 1..3661: mol_type = unassigned RNA; note = Homo sapiens C-C motif chemokine receptor 5 (CCR5), transcript variant A, mRNA, NCBI Reference Sequence: NM_000579.4
cttcagatagattatatctggagtgaagaatcctgccacctatgtatctggcatagtattctgtgtagtgggatgagcagagaacaaaaacaaaataatccagtgagaaaagcccgtaaataaaccttcagaccagagatctattctctagcttattttaagctcaacttaaaaagaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccgggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttgggttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatagaggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctgtctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataa

SEQ ID NO: 756 - RNA, 3426 nt, Homo sapiens
  source 1..3426: mol_type = unassigned RNA; note = Homo sapiens C-C motif chemokine receptor 5 (CCR5), transcript variant B, mRNA, NCBI Reference Sequence: NM_001100168.2
cttcagatagattatatctggagtgaagaatcctgccacctatgtatctggcatagtctcatctggccagaagagctgagacatccgttcccctacaagaaactctccccgggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttgggttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatagaggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctgtctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataa

SEQ ID NO: 757 - RNA, 3945 nt, Homo sapiens
  source 1..3945: mol_type = unassigned RNA; note = Homo sapiens tyrosine aminotransferase (TAT), mRNA, NCBI Reference Sequence: NM_000353.3
attgcccctgtaacctgtcaaagaagagctaagggagctttcggggttggcttcttggaggctgctttctcctttacttggaaggcttcgctagtgatggacccatacatgattcagatgagcagcaaaggcaacctcccctcaattctggacgtgcatgtcaacgttggtgggagaagctctgtgccgggaaaaatgaaaggcagaaaggccaggtggtctgtgaggccctcagacatggccaagaaaactttcaaccccatccgagccattgtggacaacatgaaggtgaaaccaaatccaaacaaaaccatgatttccctgtccattggggaccctactgtgtttggaaacctgcctacagaccctgaagttacccaggcaatgaaagatgccctggactcgggcaaatataatggctatgccccatccatcggcttcctatccagtcgggaggagattgcttcttattaccactgtcctgaggcacccctagaagctaaggacgtcattctgacaagtggctgcagccaagctattgacctttgtttagctgtgttggccaacccagggcaaaacatcctggttccaagacctggtttctctctctacaagactctggctgagtctatgggaattgaggtcaaactctacaatttgttgccagagaaatcttgggaaattgacctgaaacaactggaatatctaattgatgaaaagacagcttgtctcattgtcaataatccatcaaacccctgtgggtcagtgttcagcaaacgtcatcttcagaagattctggcagtggctgcacggcagtgtgtccccatcttagctgatgagatctatggagacatggtgttttcggattgcaaatatgaaccactggccaccctcagcaccgatgtccccatcctgtcctgtggagggctggccaagcgctggctggttcctggctggaggttgggctggatcctcattcatgaccgaagagacatttttggcaatgagatccgagatgggctggtgaagctgagtcagcgcattttgggaccctgtaccattgtccagggagctctgaaaagcatcctatgtcgcaccccgggagagttttaccacaacactctgagcttcctcaagtccaatgctgatctctgttatggggcgttggctgccatccctggactccggccagtccgcccttctggggctatgtacctcatggttggaattgagatggaacatttcccagaatttgagaacgatgtggagttcacggagcggttagttgctgagcagtctgtccactgcctcccagcaacgtgctttgagtacccgaatttcatccgagtggtcatcacagtccccgaggtgatgatgctggaggcgtgcagccggatccaggagttctgtgagcagcactaccattgtgctgaaggcagccaggaggagtgtgataaataggcctgcatccattctcctgaggatgtgtcccatctagggaaggctggactaggccttgcggctcctcagggactcaggtggccctactgggagaggggcctcaaatgcaccatgtcaagggttcaagattgttcctgcttttccccaagtacaaccacacccacactcagatcctcctcattcacatcgcagattctcccttgctctgcgctgctagagtgactcactaattcattaatctgcctccctctcgtaagatttccttctttttttcttgaaagtaccaggtgaacaaagtttaccagaaagcagttgagacaagaaaataagagctcaggatgagggaaaagaaaaagattgagagaatttgtgcccccaaccatttcctcagactctaagaaagaacacgctctctccaggcaggtctgaagctcaactctcttattgcctcacttcaggtatacctcactttacacaatagaattataactggaaagaagttggggacacatgtatttggtgattacattttaaacacattaggaaaagttgctatttgaactttttattgatttttggggggagtaaagaattattttgtgatgcaaataaatatcctttaattgatcgacttgccaaatttagatttgtgtgcatcaggctttcttttttttctttttttagagaagttcaatataagcttttcttttctttgtttctttctttctttattttgagatggagtcttgctctgtcgcccatgctggagtgcagtggcgcgatctcggctcactgcaacctccacctcctgggttcaagcgattctcttgcctcaacctcccaagcagttgggactacaggcgtgagccaccatgcccggctaatttttgtatttttagtagagacagggtttcaccatgttagccaggctggtctcaaactcctgacctcaggcaatctgcccgcctgggtctcctaaagtactgggattacaggcgtgagccacctcgcccagcggcatcaggctttcttaaagtgagagcacgcctgtactagagcaagcaggaatcagagaccttccagaaatactactgtgtaagggccagaaatatcttcacttgtcattgttatataatcattattacttttgctgtaatgttaatattgatttattaatatatattatcttttcatacattttctaagaaacatttatattgataagatcttttattttgccaagggcataaattattgtttttctttttttttttttaataaatttcaccaagtatggctcttctgtgatgtgtttttttctccgtttgggaatttctaatcccaggcactcctcagtctcattgtttcattacctatgaggtttcatttacttctttgtaaatgtactgacttttggagttacttaagaaccacagttcctaaaacattttatttgggagctcaacttctggcttcctacttaccaagaggcagtaagttataacctctggcctttgtctttacattttcaactttctggatccctaacctctggtcccaagttactacgcttgcctatatccactaaccactcactaggtcacaaagttgatggctctggcttgacccagtgaatgagaagtgtcctagatgtttttttttttttttttttttcgcaaatcttcataggcacagttgcctgtttaattttttcttcagcccttcccttagaggagggagccttaagttacctttcaaggttgggggttaggaatctatcataactagtctagagatttctcaccaagggaaattttccttatctaaaagaggaacttcaggtctcaaccctgccagtcacacccaattaatgtccttcacaaaaataaacagcatatgttccctttcaatttgagttcagtgagctcacagcaaaatttaccttttaattttcttcagcaaatccaagacgaatatacaaaggatgagattagataaagatttcagtttcccgtatgccaccgctgccgccaattttccaaaaaagcctggctcctcttttcctgttcctccatccaagcccccaaagatctctaaccagaaataaacaggaagactcagtgatttacaaaagacattttagttttacacgtacagaaaattctacccagcattacagaattcttagacttcttaaattcctgattttccttggtatttacattttgataagggagccaatggttcttcaaacatttgaaaagaacacatacacactggacaatttcaaacgatacaaacaaacgcaactgtccttctttctcattcctgtccttcagccacccagtttcttctcccctgagggaatcagttatcatttgctggtcatacttccagattatactgtgcctatgtaagtgtgtgtgtgtgtgtgtgtgtgtgcacttttcattttttcaaataaagtattactcaactttgtaa

SEQ ID NO: 758 - RNA, 6070 nt, Homo sapiens
  source 1..6070: mol_type = unassigned RNA; note = Homo sapiens protein kinase N2 (PKN2), transcript variant 1, mRNA, NCBI Reference Sequence: NM_006256.4
gcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccttacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcaaaaataatttgatgaaatattttatacaactcttcaaaggatccgtctgtggctttttatactcttttagggttgtctttttacaaaccatgactttccacttgcctgtagttttttgtttgttttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcatttcgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgtaactttggttttaagtattctttccttttagaaacttcctaatgattaaaatatactttaacttttctgtgttcaaaatctcaaagactaattaactttaataaacattcttgcaagtactttttgtcctagtgaaggcttaaaaccatgaacattcagagcaaactgtccacttcattgggaataatgggaaaagtttgtattctgctcctgtaaggtcagtagcatcttttatttgaagcatatttatggactgcttactgtgtatagatactgagaataggaagtttttttttttaaagcaacaaaatgttgatgaatgaagaacagcctgttttaattaagatgcaagcaccagtattgtatgtacttttctcttgtttgaggttagcttattttaatttaggacctggcttctcaaaaaggcaaatgaataaaacagaatactagta

SEQ ID NO: 759 - RNA, 5926 nt, Homo sapiens
  source 1..5926: mol_type = unassigned RNA; note = Homo sapiens protein kinase N2 (PKN2), transcript variant 2, mRNA, NCBI Reference Sequence: NM_001320707.2
gcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccttacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacagggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcaaaaataatttgatgaaatattttatacaactcttcaaaggatccgtctgtggctttttatactcttttagggttgtctttttacaaaccatgactttccacttgcctgtagttttttgtttgttttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcatttcgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgtaactttggttttaagtattctttccttttagaaacttcctaatgattaaaatatactttaacttttctgtgttcaaaatctcaaagactaattaactttaataaacattcttgcaagtactttttgtcctagtgaaggcttaaaaccatgaacattcagagcaaactgtccacttcattgggaataatgggaaaagtttgtattctgctcctgtaaggtcagtagcatcttttatttgaagcatatttatggactgcttactgtgtatagatactgagaataggaagtttttttttttaaagcaacaaaatgttgatgaatgaagaacagcctgttttaattaagatgcaagcaccagtattgtatgtacttttctcttgtttgaggttagcttattttaatttaggacctggcttctcaaaaaggcaaatgaataaaacagaatactagta

SEQ ID NO: 760 - RNA, 5769 nt, Homo sapiens
  source 1..5769: mol_type = unassigned RNA; note = Homo sapiens protein kinase N2 (PKN2), transcript variant 3, mRNA, NCBI Reference Sequence: NM_001320708.2
gcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagattgcccaaggactccagatactccaaataatgaccctcgttgttctactagcaacaatagattgaaggccttacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcaaaaataatttgatgaaatattttatacaactcttcaaaggatccgtctgtggctttttatactcttttagggttgtctttttacaaaccatgactttccacttgcctgtagttttttgtttgttttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcatttcgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgtaactttggttttaagtattctttccttttagaaacttcctaatgattaaaatatactttaacttttctgtgttcaaaatctcaaagactaattaactttaataaacattcttgcaagtactttttgtcctagtgaaggcttaaaaccatgaacattcagagcaaactgtccacttcattgggaataatgggaaaagtttgtattctgctcctgtaaggtcagtagcatcttttatttgaagcatatttatggactgcttactgtgtatagatactgagaataggaagtttttttttttaaagcaacaaaatgttgatgaatgaagaacagcctgttttaattaagatgcaagcaccagtattgtatgtacttttctcttgtttgaggttagcttattttaatttaggacctggcttctcaaaaaggcaaatgaataaaacagaatactagta

SEQ ID NO: 761 - RNA, 6022 nt, Homo sapiens
  source 1..6022: mol_type = unassigned RNA; note = Homo sapiens protein kinase N2 (PKN2), transcript variant 4, mRNA, NCBI Reference Sequence: NM_001320709.2
gcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccttacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcaaaaataatttgatgaaatattttatacaactcttcaaaggatccgtctgtggctttttatactcttttagggttgtctttttacaaaccatgactttccacttgcctgtagttttttgtttgttttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcatttcgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgtaactttggttttaagtattctttccttttagaaacttcctaatgattaaaatatactttaacttttctgtgttcaaaatctcaaagactaattaactttaataaacattcttgcaagtactttttgtcctagtgaaggcttaaaaccatgaacattcagagcaaactgtccacttcattgggaataatgggaaaagtttgtattctgctcctgtaaggtcagtagcatcttttatttgaagcatatttatggactgcttactgtgtatagatactgagaataggaagtttttttttttaaagcaacaaaatgttgatgaatgaagaacagcctgttttaattaagatgcaagcaccagtattgtatgtacttttctcttgtttgaggttagcttattttaatttaggacctggcttctcaaaaaggcaaatgaataaaacagaatactagta

SEQ ID NO: 762 - RNA, 6204 nt, Homo sapiens
  source 1..6204: mol_type = unassigned RNA; note = Homo sapiens protein kinase N2 (PKN2), transcript variant X3, mRNA, NCBI Reference Sequence: XM_011541772.2
ttcattacatatatctttttaaaaaacaatttcacaaggccagatttattaaaggaatatactttattctgcaattatgtccatcctagatactagatactatgtgatctgatctgtaccacatgaggaccttcttactccatcattttctctgacatcacctacaaaggcttcttttttatggaccatgtgaatatgacatatttttgttacacagactttccagaatcctttaattttcttataaatattaatgccaacaaaccttaaaatttttgaggttatgaaagtgttcttcaatattgcatagcatactatcacattccggttgttaaagagtatcattaatcagttttattctgtgttaaacttatacatcaaaacatgaaggacaaatttacagttaaacttcgctgttgccactaattaggatcagtctaaatgtgcagttcacaaattgagtgcttaaatctgaggcaacctgggataccaaagtgaattcacagggccacatcaggattttgtttttgagggatgcacagcattatctgtacttcatgtagtcaccattcagactactagctcaaggtagttacagtttcagggttaggtggagctacattcctttcagtgatgttgtgtatttatgaagctgggttttcctcaattgctgtgattttggtttttttaaagtgctgtgtgaaatcagtgtggaataggaaatcagtgtggtagtttccaaactgattccaaagctttagagttatacagtgcccaaaaagaagtaatcttgcttaagaatgaaatgaaaatactttttcttttagttatatgtattttttttcaaatagctattaatttgttaggaaagcaatcatatcctatgtttggacctaactgtttaatcaacaaaactataaggtatatcttttggcctagggacacagttaaaaaatagtttaataaaacattagggcaccatgaactgagaaagcttgggaacctctgatctaattctttcatattgataactatttatctttccagtcatatctgtgtaactcctatcatgaatattctgtcataaactggtttgtgcccagtgcctcccctaccttgcttaaatgtctttgccttagtattcatcttcttatatgtatttttaaatcaaaactggaatatagacctgtaaagagcaaagaccttgtcatctacctacatataatcctagcctccagcacaggatatttgatacattcaacaagtacttggtaaatagtatctgacaattaggcagggactatactgcaggcaaggactgtacttattgtctgctaagtttcaccaccttttggctcaatgctgaacacattgttgatactcaagcatttctgaatgatccattgattaaaataaggttgtcaaatattttgaataacaatatttctagaaaagtaataaaatcacattttagaaactcagctgataatgactggaaatttttttccttttctattctagtctcctgttccctcctttcagttccttcttcccctgttcctcattccattactgaactttactcaaagttatataagtcaccaacctaaaaagaagtatcttacaattcttaagacatttttaaaaaattctttaagctcctactggaccataaactaaattttaagtaactagggagagaaatactactgacattaatagaagactacacatgacgaaaagatgaacatggatgaatagtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcaaaaataatttgatgaaatattttatacaactcttcaaaggatccgtctgtggctttttatactcttttagggttgtctttttacaaaccatgactttccacttgcctgtagttttttgtttgttttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcatttcgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgtaactttggttttaagtattctttccttttagaaacttcctaatgattaaaatatactttaacttttctgtgttcaaaatctcaaagactaattaactttaataaacattcttgcaagta

SEQ ID NO: 763 - RNA, 5585 nt, Homo sapiens
  source 1..5585: mol_type = unassigned RNA; note = Homo sapiens protein kinase N2 (PKN2), transcript variant X1, mRNA, NCBI Reference Sequence: XM_017001782.2
acagccaaatggtgcgacaggaggagctgcagccgcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccttacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacagatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcaaaaataatttgatgaaatattttatacaactcttcaaaggatccgtctgtggctttttatactcttttagggttgtctttttacaaaccatgactttccacttgcctgtagttttttgtttgttttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcatttcgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgtaactttggttttaagtattctttccttttagaaacttcctaatgattaaaatatactttaacttttctgtgttcaaaatctcaaagactaattaactttaataaacattcttgcaagta

SEQ ID NO: 764 - RNA, 5579 nt, Homo sapiens
  source 1..5579: mol_type = unassigned RNA; note = Homo sapiens protein kinase N2 (PKN2), transcript variant X2, mRNA, NCBI Reference Sequence: XM_017001783.2
acagccaaatggtgcgacaggaggagctgcagccgcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccttacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaaatgatgtctgtgctgttttgaagctcgataatactgtggttggccaaactagctggaaacccatttccaatcagtcatgggaccagaagtttacactggaactggacagggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcaaaaataatttgatgaaatattttatacaactcttcaaaggatccgtctgtggctttttatactcttttagggttgtctttttacaaaccatgactttccacttgcctgtagttttttgtttgttttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcatttcgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgtaactttggttttaagtattctttccttttagaaacttcctaatgattaaaatatactttaacttttctgtgttcaaaatctcaaagactaattaactttaataaacattcttgcaagta

SEQ ID NO: 765 - RNA, 3310 nt, Homo sapiens
  source 1..3310: mol_type = unassigned RNA; note = Homo sapiens EPH receptor A1 (EPHA1), mRNA, NCBI Reference Sequence: NM_005232.5
gcaacctggcgctgccatccgggccactgtcccaggtcccggcccggagctatggagcggcgctggcccctggggctagggctggtgctgctgctctgcgccccgctgcccccgggggcgcgcgccaaggaagttactctgatggacacaagcaaggcacagggagagctgggctggctgctggatcccccaaaagatgggtggagtgaacagcaacagatactgaatgggacacccctgtacatgtaccaggactgcccaatgcaaggacgcagagacactgaccactggcttcgctccaattggatctaccgcggggaggaggcttcccgcgtccacgtggagctgcagttcaccgtgcgggactgcaagagtttccctgggggagccgggcctctgggctgcaaggagaccttcaaccttctgtacatggagagtgaccaggatgtgggcattcagctccgacggcccttgttccagaaggtaaccacggtggctgcagaccagagcttcaccattcgagaccttgtgtctggctccgtgaagctgaatgtggagcgctgctctctgggccgcctgacccgccgtggcctctacctcgctttccacaacccgggtgcctgtgtggccctggtgtctgtccgggtcttctaccagcgctgtcctgagaccctgaatggcttggcccaattcccagacactctgcctggccccgctgggttggtggaagtggcggggacctgcttgccccacgcgcgggccagccccaggccctcaggtgcaccccgcatgcactgcagccctgatggcgagtggctggtgcctgtaggacggtgccactgtgagcctggctatgaggaaggtggcagtggcgaagcatgtgttgcctgccctagcggctcctaccggatggacatggacacaccccattgtctcacgtgcccccagcagagcactgctgagtctgagggggccaccatctgtacctgtgagagcggccattacagagctcccggggagggcccccaggtggcatgcacaggtcccccctcggccccccgaaacctgagcttctctgcctcagggactcagctctccctgcgttgggaacccccagcagatacggggggacgccaggatgtcagatacagtgtgaggtgttcccagtgtcagggcacagcacaggacggggggccctgccagccctgtggggtgggcgtgcacttctcgccgggggcccgggggctcaccacacctgcagtgcatgtcaatggccttgaaccttatgccaactacacctttaatgtggaagcccaaaatggagtgtcagggctgggcagctctggccatgccagcacctcagtcagcatcagcatggggcatgcagagtcactgtcaggcctgtctctgagactggtgaagaaagaaccgaggcaactagagctgacctgggcggggtcccggccccgaagccctggggcgaacctgacctatgagctgcacgtgctgaaccaggatgaagaacggtaccagatggttctagaacccagggtcttgctgacagagctgcagcctgacaccacatacatcgtcagagtccgaatgctgaccccactgggtcctggccctttctcccctgatcatgagtttcggaccagcccaccagtgtccaggggcctgactggaggagagattgtagccgtcatctttgggctgctgcttggtgcagccttgctgcttgggattctcgttttccggtccaggagagcccagcggcagaggcagcagaggcagcgtgaccgcgccaccgatgtggatcgagaggacaagctgtggctgaagccttatgtggacctccaggcatacgaggaccctgcacagggagccctggactttacccgggagcttgatccagcgtggctgatggtggacactgtcataggagaaggagagtttggggaagtgtatcgagggaccctgaggctccccagccaggactgcaagactgtggccattaagaccttaaaagacacatccccaggtggccagtggtggaacttccttcgagaggcaactatcatgggccagtttagccacccgcatattctgcatctggaaggcgtcgtcacaaagcgaaagccgatcatgatcatcacagaatttatggagaatggagccctggatgccttcctgagggagcgggaggaccagctggtccctgggcagctagtggccatgctgcagggcatagcatctggcatgaactacctcagtaatcacaattatgtccaccgggacctggctgccagaaacatcttggtgaatcaaaacctgtgctgcaaggtgtctgactttggcctgactcgcctcctggatgactttgatggcacatacgaaacccagggaggaaagatccctatccgttggacagcccctgaagccattgcccatcggatcttcaccacagccagcgatgtgtggagctttgggattgtgatgtgggaggtgctgagctttggggacaagccttatggggagatgagcaatcaggaggttatgaagagcattgaggatgggtaccggttgccccctcctgtggactgccctgcccctctgtatgagctcatgaagaactgctgggcatatgaccgtgcccgccggccacacttccagaagcttcaggcacatctggagcaactgcttgccaacccccactccctgcggaccattgccaactttgaccccaggatgactcttcgcctgcccagcctgagtggctcagatgggatcccatatcgaaccgtctctgagtggctcgagtccatacgcatgaaacgctacatcctgcacttccactcggctgggctggacaccatggagtgtgtgctggagctgaccgctgaggacctgacgcagatgggaatcacactgcccgggcaccagaagcgcattctttgcagtattcagggattcaaggactgatccctcctctcaccccatgcccaatcagggtgcaaggagcaaggacggggccaaggtcgctcatggtcactccctgcgccccttcccacaacctgccagactaggctatcggtgctgcttctgcccactttcaggagaaccctgctctgcaccccagaaaacctctttgttttaaaagggaggtgggggtagaagtaaaaggatgatcatgggagggagctgaggggttaatatatatacatacatacacatatatatatttttgtaaataaacaggaactgattttctgcctccatcccacccatgagggctgcaggcactacaaaa

SEQ ID NO: 766 - RNA, 3257 nt, Homo sapiens
  source 1..3257: mol_type = unassigned RNA; note = Homo sapiens Jun proto-oncogene, AP-1 transcription factor subunit (JUN), mRNA, NCBI Reference Sequence: NM_002228.4
gctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagccaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcacgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccacagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaataccaa

SEQ ID NO: 767 - RNA, 6070 nt, Homo sapiens
  source 1..6070: mol_type = unassigned RNA; note = Homo sapiens CF transmembrane conductance regulator (CFTR), mRNA, NCBI Reference Sequence: NM_000492.4
gtagtaggtctttggcattaggagcttgagcccagacggccctagcagggaccccagcgcccgagagaccatgcagaggtcgcctctggaaaaggccagcgttgtctccaaactttttttcagctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagactttaaagctgtcaagccgtgttctagataaaataagtattggacaacttgttagtctcctttccaacaacctgaacaaatttgatgaaggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagacttgtgattacctcagaaatgattgaaaatatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggagtgcttttttgatgatatggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacagaaagtatttattttttctggaacatttagaaaaaacttggatccctatgaacagtggagtgatcaagaaatatggaaagttgcagatgaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtaacataccaaataattagaagaactctaaaacaagcatttgctgattgcacagtaattctctgtgaacacaggatagaagcaatgctggaatgccaacaatttttggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttagagagcagcataaatgttgacatgggacatttgctcatggaattggagctcgtgggacagtcacctcatggaattggagctcgtggaacagttacctctgcctcagaaaacaaggatgaattaagtttttttttaaaaaagaaacatttggtaaggggaattgaggacactgatatgggtcttgataaatggcttcctggcaatagtcaaattgtgtgaaaggtacttcaaatccttgaagatttaccacttgtgttttgcaagccagattttcctgaaaacccttgccatgtgctagtaattggaaaggcagctctaaatgtcaatcagcctagttgatcagcttattgtctagtgaaactcgttaatttgtagtgttggagaagaactgaaatcatacttcttagggttatgattaagtaatgataactggaaacttcagcggtttatataagcttgtattcctttttctctcctctccccatgatgtttagaaacacaactatattgtttgctaagcattccaactatctcatttccaagcaagtattagaataccacaggaaccacaagactgcacatcaaaatatgccccattcaacatctagtgagcagtcaggaaagagaacttccagatcctggaaatcagggttagtattgtccaggtctaccaaaaatctcaatatttcagataatcacaatacatcccttacctgggaaagggctgttataatctttcacaggggacaggatggttcccttgatgaagaagttgatatgccttttcccaactccagaaagtgacaagctcacagacctttgaactagagtttagctggaaaagtatgttagtgcaaattgtcacaggacagcccttctttccacagaagctccaggtagagggtgtgtaagtagataggccatgggcactgtgggtagacacacatgaagtccaagcatttagatgtataggttgatggtggtatgttttcaggctagatgtatgtacttcatgctgtctacactaagagagaatgagagacacactgaagaagcaccaatcatgaattagttttatatgcttctgttttataattttgtgaagcaaaattttttctctaggaaatatttattttaataatgtttcaaacatatataacaatgctgtattttaaaagaatgattatgaattacatttgtataaaataatttttatatttgaaatattgactttttatggcactagtatttctatgaaatattatgttaaaactgggacaggggagaacctagggtgatattaaccaggggccatgaatcaccttttggtctggagggaagccttggggctgatgcagttgttgcccacagctgtatgattcccagccagcacagcctcttagatgcagttctgaagaagatggtaccaccagtctgactgtttccatcaagggtacactgccttctcaactccaaactgactcttaagaagactgcattatatttattactgtaagaaaatatcacttgtcaataaaatccatacatttgtgtgaaa

SEQ ID NO: 768 - RNA, 3149 nt, Homo sapiens
  source 1..3149: mol_type = unassigned RNA; note = Homo sapiens sodium channel epithelial 1 subunit alpha (SCNN1A), transcript variant 1, mRNA, NCBI Reference Sequence: NM_001038.6
gcttccatccctggccggccagcgggcgggctccccagccaggccgctgcacctgtcaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaa

SEQ ID NO: 769 - RNA, 3198 nt, Homo sapiens
  source 1..3198: mol_type = unassigned RNA; note = Homo sapiens sodium channel epithelial 1 subunit alpha (SCNN1A), transcript variant 3, mRNA, NCBI Reference Sequence: NM_001159575.2
aacctcagaaaactgatttatccttgggaagggtcagtttcttcattaggacaatgaagaaaaatccagctgtcccttccaaggggaggtatcatgagcagtatcaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaa

SEQ ID NO: 770 - RNA, 3703 nt, Homo sapiens
  source 1..3703: mol_type = unassigned RNA; note = Homo sapiens sodium channel epithelial 1 subunit alpha (SCNN1A), transcript variant 2, mRNA, NCBI Reference Sequence: NM_001159576.2
agtccagccgcaacctgggagtgggaagctggaggcagcccagacctcctggagccctgcagtcctggggcagagacagaatcaggacacagctcgaggtcagggccagaggctggagctgagggcctagagtgagagggggcaaggcaagggggggagaggaagagaggcaggattagagagaggaggcaggccagaaagaggagagcaggagagacccaaagagaaacagaaggcagatagagagggagtgagaggcaggagctgagacacagatcctggaggaagaagaccaaaggaagggggcagagacagaaagggaggtgctaggacaaaactcgaaaggtggccctatcagggaagcagaggagaggccgttctagggaagcccagctccggcacttttggccccaactcccgcaggtctgctggctccaggaaaggtggaggagggagggaggagtgggagaatgtgggcgcagggtgggacatgggcatggccaggggcagcctcactcgggttccaggggtgatgggagagggcactcagggcccagagctcagccttgaccctgacccttgctctccccaatccactccggggctcatgaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaa

SEQ ID NO: 771 - RNA, 8558 nt, Homo sapiens
  source 1..8558: mol_type = unassigned RNA; note = Homo sapiens X-linked inhibitor of apoptosis (XIAP), transcript variant 1, mRNA, NCBI Reference Sequence: NM_001167.4
gaggccctgacgtggacacacttcgggtttcacgactccgggtttctccaggggatgggccggccggtagaggcgcgtgagggagacgaagggacttccgtttccttcacctaggctggggccaagccgcagagcggagttggcatttccagattggggctcgggccgcgcctcctccgggaccctccccttggaccgagccgatcgccgcggggcagttcgggccggctgtcctggcgcgaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaatta

SEQ ID NO: 772 - RNA, 8409 nt, Homo sapiens
  source 1..8409: mol_type = unassigned RNA; note = Homo sapiens X-linked inhibitor of apoptosis (XIAP), transcript variant 2, mRNA, NCBI Reference Sequence: NM_001204401.2
cttactgcccccatccggttcggggaggtggcgggaccttggcggcgcccggagccggcgtggcgctcatcgagggacgcccggcccaagtgaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaatta

SEQ ID NO: 773 - RNA, 8413 nt, Homo sapiens
  source 1..8413: mol_type = unassigned RNA; note = Homo sapiens X-linked inhibitor of apoptosis (XIAP), transcript variant 4, mRNA, NCBI Reference Sequence: NM_001378590.1
gcttgcccgggttcctcggactgccgacggcaggcgtgggtgggtgggtgacttcaggcctgcaggattgccttcctaaaccctgtgacacctaagaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaatta

SEQ ID NO: 774 - RNA, 8536 nt, Homo sapiens
  source 1..8536: mol_type = unassigned RNA; note = Homo sapiens X-linked inhibitor of apoptosis (XIAP), transcript variant 5, mRNA, NCBI Reference Sequence: NM_001378591.1
cttactgcccccatccggttcggggaggtggcgggaccttggcggcgcccggagccggcgtggcgctcatcgagggacgcccggcccaagtggctggggccaagccgcagagcggagttggcatttccagattggggctcgggccgcgcctcctccgggaccctccccttggaccgagccgatcgccgcggggcagttcgggccggctgtcctggcgcgaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaatta

SEQ ID NO: 775 - RNA, 8348 nt, Homo sapiens
  source 1..8348: mol_type = unassigned RNA; note = Homo sapiens X-linked inhibitor of apoptosis (XIAP), transcript variant 6, mRNA, NCBI Reference Sequence: NM_001378592.1
gaggtgctcactgcgcatgtgcgcgcgctagaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaatta

SEQ ID NO: 776 - RNA, 7649 nt, Homo sapiens
  source 1..7649: mol_type = unassigned RNA; note = Homo sapiens X-linked inhibitor of apoptosis (XIAP), transcript variant 3, non-coding RNA, NCBI Reference Sequence: NR_037916.2
gaggccctgacgtggacacacttcgggtttcacgactccgggtttctccaggggatgggccggccggtagaggcgcgtgagggagacgaagggacttccgtttccttcacctaggctggggccaagccgcagagcggagttggcatttccagattggggctcgggccgcgcctcctccgggaccctccccttggaccgagccgatcgccgcggggcagttcgggccggctgtcctggcgcggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaatta

SEQ ID NO: 777 - RNA, 7631 nt, Homo sapiens
  source 1..7631: mol_type = unassigned RNA; note = Homo sapiens X-linked inhibitor of apoptosis (XIAP), transcript variant 7, non-coding RNA, NCBI Reference Sequence: NR_165803.1
gaggtgctcactgcgcatgtgcgcgcgctaggtggcgggaccttggcggcgcccggagccggcgtggcgctcatcgagggacgcccggcccaagtggctggggccaagccgcagagcggagttggcatttccagattggggctcgggccgcgcctcctccgggaccctccccttggaccgagccgatcgccgcggggcagttcgggccggctgtcctggcgcggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaatta

SEQ ID NO: 778 - RNA, 4039 nt, Homo sapiens
  source 1..4039: mol_type = unassigned RNA; note = Homo sapiens telomerase reverse transcriptase (TERT), transcript variant 1, mRNA, NCBI Reference Sequence: NM_198253.3
ctctcctcgcggcgcgagtttcaggcagcgctgcgtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaa

SEQ ID NO: 779 - RNA, 3850 nt, Homo sapiens
  source 1..3850: mol_type = unassigned RNA; note = Homo sapiens telomerase reverse transcriptase (TERT), transcript variant 2, mRNA, NCBI Reference Sequence: NM_001193376.3
ctctcctcgcggcgcgagtttcaggcagcgctgcgtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaa

SEQ ID NO: 780 - RNA, 3668 nt, Homo sapiens
  source 1..3668: mol_type = unassigned RNA; note = Homo sapiens telomerase reverse transcriptase (TERT), transcript variant 3, non-coding RNA, NCBI Reference Sequence: NR_149162.3
ctctcctcgcggcgcgagtttcaggcagcgctgcgtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaa

SEQ ID NO: 781 - RNA, 3632 nt, Homo sapiens
  source 1..3632: mol_type = unassigned RNA; note = Homo sapiens telomerase reverse transcriptase (TERT), transcript variant 4, non-coding RNA, NCBI Reference Sequence: NR_149163.3
ctctcctcgcggcgcgagtttcaggcagcgctgcgtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggacaggctcacggaggtcatcgccagcatcatcaaaccccagaacacgtactgcgtgcgtcggtatgccgtggtccagaaggccgcccatgggcacgtccgcaaggccttcaagagccacgtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaa

SEQ ID NO: 782 - RNA, 12235 nt, Homo sapiens
  source 1..12235: mol_type = unassigned RNA; note = Homo sapiens insulin like growth factor 1 receptor (IGF1R), transcript variant 1, mRNA, NCBI Reference Sequence: NM_000875.5
agtgtgtggcagcggcggcggcggcgcggcgaggctggggctcttgtttaccagcattaactccgctgagcggaaaaaaaaagggaaaaaacccgaggaggagcgagcgcaccaggcgaactcgagagaggcgggagagcgagagggacgccgccagcgagcctgcccacggccggcgctcgcagaccctcggccccgctccccggatccccccgcgccctccacgcccctcccgcgcgggggcagctccacggcgcgcctcgcctcggctgtgaccttcagcgagccggagcccccgcgcagagcaggcggcggcgggcgggggccgggcgggggccggcgcggggcgggcggcggcgcagagccgggcggcgcggcgggagtgctgagcgcggcgcggccggcccgccgctttgtgtgtgtcctggatttgggaaggagctcgccgcggcggcggcggcgctgagggaggaggcggcggcgagcggagccaggaggaggaggaggagggggagccgctcattcattttgactccgcgtttctgcccctcgccggcctcgcctgtgacccggacttcggggcgatcttgcgaactgcgtcgcgccctcccgcggcggaagctcgggcgtccggccgcctcccgcgcggccagggccgggcttgtttttcctcgcctaggcagatttgggctttgccccctttctttgcagttttccccccttcctgcctctccgggtttgaaaatggaggccgacgacgccgacagcccgccccggcgcgcctcgggttcccgactccgccgagccctgggccgctgctgccggcgctgaggggccgccccgcgccgcccgccccgtccgcgcacccggagggccccggcggcgccgccttcggagtattgtttccttcgcccttgtttttggagggggagcgaagactgagtttgagacttgtttcctttcatttcctttttttcttttcttttcttttttttttttttttttttttttgagaaaggggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaaggtattatatgtaggagttttcttttaatttattttgtgataaattaccagtttcaatcactgtagaaaagccccattatgaatttaaatttcaaggaaagggtgtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaaggcgtggggcattgggtttgctccccttgctgctgctccatccctgcaggaggctcgcgctgaggcaggaccgtgcggccatggctgctgcattcattgagcacaaaggtgcagctgcagcagcagctggagagcaagagtcacccagcctgtgcgccagaatgcagaggctcctgacctcacagccagtccctgatagaacacacgcaggagcagagtcccctccccctccaggctgccctctcaacttctccctcacctccttccctaggggtagacagagatgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcactttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacactgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccctcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgactgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgca

SEQ ID NO: 783 - RNA, 12232 nt, Homo sapiens
  source 1..12232: mol_type = unassigned RNA; note = Homo sapiens insulin like growth factor 1 receptor (IGF1R), transcript variant 2, mRNA, NCBI Reference Sequence: NM_001291858.2
agtgtgtggcagcggcggcggcggcgcggcgaggctggggctcttgtttaccagcattaactccgctgagcggaaaaaaaaagggaaaaaacccgaggaggagcgagcgcaccaggcgaactcgagagaggcgggagagcgagagggacgccgccagcgagcctgcccacggccggcgctcgcagaccctcggccccgctccccggatccccccgcgccctccacgcccctcccgcgcgggggcagctccacggcgcgcctcgcctcggctgtgaccttcagcgagccggagcccccgcgcagagcaggcggcggcgggcgggggccgggcgggggccggcgcggggcgggcggcggcgcagagccgggcggcgcggcgggagtgctgagcgcggcgcggccggcccgccgctttgtgtgtgtcctggatttgggaaggagctcgccgcggcggcggcggcgctgagggaggaggcggcggcgagcggagccaggaggaggaggaggagggggagccgctcattcattttgactccgcgtttctgcccctcgccggcctcgcctgtgacccggacttcggggcgatcttgcgaactgcgtcgcgccctcccgcggcggaagctcgggcgtccggccgcctcccgcgcggccagggccgggcttgtttttcctcgcctaggcagatttgggctttgccccctttctttgcagttttccccccttcctgcctctccgggtttgaaaatggaggccgacgacgccgacagcccgccccggcgcgcctcgggttcccgactccgccgagccctgggccgctgctgccggcgctgaggggccgccccgcgccgcccgccccgtccgcgcacccggagggccccggcggcgccgccttcggagtattgtttccttcgcccttgtttttggagggggagcgaagactgagtttgagacttgtttcctttcatttcctttttttcttttcttttcttttttttttttttttttttttttgagaaaggggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaagatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaaggtattatatgtaggagttttcttttaatttattttgtgataaattaccagtttcaatcactgtagaaaagccccattatgaatttaaatttcaaggaaagggtgtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaaggcgtggggcattgggtttgctccccttgctgctgctccatccctgcaggaggctcgcgctgaggcaggaccgtgcggccatggctgctgcattcattgagcacaaaggtgcagctgcagcagcagctggagagcaagagtcacccagcctgtgcgccagaatgcagaggctcctgacctcacagccagtccctgatagaacacacgcaggagcagagtcccctccccctccaggctgccctctcaacttctccctcacctccttccctaggggtagacagagatgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcactttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacactgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccctcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgactgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgca

SEQ ID NO: 784 - RNA, 4681 nt, Homo sapiens
  source 1..4681: mol_type = unassigned RNA; note = Homo sapiens insulin like growth factor 1 receptor (IGF1R), transcript variant X6, mRNA, NCBI Reference Sequence: XM_011521516.2
aaacccaccaaaaccaagatggtaacgagagtgacctgtgatcgtcctcactgctgcactcccaccagcgccatgagtgtttacatgtcatagcaacatcaggaagttaccctatatggtctaaaatggagagtgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaa

SEQ ID NO: 785 - RNA, 4094 nt, Homo sapiens
  source 1..4094: mol_type = unassigned RNA; note = Homo sapiens insulin like growth factor 1 receptor (IGF1R), transcript variant X7, mRNA, NCBI Reference Sequence: XM_011521517.2
ttccatccttgaaaagcacagtgtcctccccactggggaacaccaatccttaaaaaacttctttctcattgcaaatcgaaggaggctgccgctgcacccagccccagactcctcagtcacttacctggcaagctgaggccctaccagtttaaggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaa

SEQ ID NO: 786 - RNA, 11738 nt, Homo sapiens
  source 1..11738: mol_type = unassigned RNA; note = Homo sapiens insulin like growth factor 1 receptor (IGF1R), transcript variant X1, mRNA, NCBI Reference Sequence: XM_017022136.1
cgcccggcaggaacccagcttcatttcttgtaaagagagtttgacaagcgctccactggggatagcagcacagcttcctccttttctgtccctgtctccctcctgactctgcatctgcctccgtttgaagcatcctcctccagtaagtgggtcatttggattccaaggcccttttgaggccatggtgatggatcatttgcgttatcaatgtgaactgtggatgtcccttcgcccttcagtctcttccttcttcaaggagggggaggtaattgggggtcatgtggcctggggaagagcctggtcacgagcatgagggatgtgagtgggactatgtttccagccaaaatttagggcacaggatctgaaaaacacttagattaagtatctgcaacacaaattagggtattttaaattgaatgtggagaaccctgagaacctgtgccctttgtgcgtggatggctgcttgcaaggatgagcatccccagctggagcggcccatggctgccagaacaggagaaggcttcagtcaggtgggaagccagctgcagtgtgttgcctgatgcaggatggtgcgagaaggagctgctctcttgctctgctccctggatcgcacaaggtcttcctgagaccagaattcaagtctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaaggtattatatgtaggagttttcttttaatttattttgtgataaattaccagtttcaatcactgtagaaaagccccattatgaatttaaatttcaaggaaagggtgtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaaggcgtggggcattgggtttgctccccttgctgctgctccatccctgcaggaggctcgcgctgaggcaggaccgtgcggccatggctgctgcattcattgagcacaaaggtgcagctgcagcagcagctggagagcaagagtcacccagcctgtgcgccagaatgcagaggctcctgacctcacagccagtccctgatagaacacacgcaggagcagagtcccctccccctccaggctgccctctcaacttctccctcacctccttccctaggggtagacagagatgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcactttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacactgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccctcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgactgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgca

SEQ ID NO: 787 - RNA, 11252 nt, Homo sapiens
  source 1..11252: mol_type = unassigned RNA; note = Homo sapiens insulin like growth factor 1 receptor (IGF1R), transcript variant X2, mRNA, NCBI Reference Sequence: XM_017022137.1
cgcccggcaggaacccagcttcatttcttgtaaagagagtttgacaagcgctccactggggatagcagcacagcttcctccttttctgtccctgtctccctcctgactctgcatctgcctccgtttgaagcatcctcctccagtaagtgggtcatttggattccaaggcccttttgaggccatggtgatggatcatttgcgttatcaatgtgaactgtggatgtcccttcgcccttcagtctcttccttcttcaaggagggggaggtaattgggggtcatgtggcctggggaagagcctggtcacgagcatgagggatgtgagtgggactatgtttccagccaaaatttagggcacaggatctgaaaaacacttagattaagtatctgcaacacaaattagggtattttaaattgaatgtggagaaccctgagaacctgtgccctttgtgcgtggatggctgcttgcaaggatgagcatccccagctggagcggcccatggctgccagaacaggagaaggcttcagtcaggtgggaagccagctgcagtgtgttgcctgatgcaggatggtgcgagaaggagctgctctcttgctctgctccctggatcgcacaaggtcttcctgagaccagaattcaagtctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaaggtattatatgtaggagttttcttttaatttattttgtgataaattaccagtttcaatcactgtagaaaagccccattatgaatttaaatttcaaggaaagggtgtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaaggcgtggggcattgggtttgctccccttgctgctgctccatccctgcaggaggctcgcgctgaggcaggaccgtgcggccatggctgctgcattcattgagcacaaaggtgcagctgcagcagcagctggagagcaagagtcacccagcctgtgcgccagaatgcagaggctcctgacctcacagccagtccctgatagaacacacgcaggagcagagtcccctccccctccaggctgccctctcaacttctccctcacctccttccctaggggtagacagagatgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcactttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacactgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccctcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgactgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgca

SEQ ID NO: 788 - RNA, 11735 nt, Homo sapiens
  source 1..11735: mol_type = unassigned RNA; note = Homo sapiens insulin like growth factor 1 receptor (IGF1R), transcript variant X3, mRNA, NCBI Reference Sequence: XM_017022138.1
cgcccggcaggaacccagcttcatttcttgtaaagagagtttgacaagcgctccactggggatagcagcacagcttcctccttttctgtccctgtctccctcctgactctgcatctgcctccgtttgaagcatcctcctccagtaagtgggtcatttggattccaaggcccttttgaggccatggtgatggatcatttgcgttatcaatgtgaactgtggatgtcccttcgcccttcagtctcttccttcttcaaggagggggaggtaattgggggtcatgtggcctggggaagagcctggtcacgagcatgagggatgtgagtgggactatgtttccagccaaaatttagggcacaggatctgaaaaacacttagattaagtatctgcaacacaaattagggtattttaaattgaatgtggagaaccctgagaacctgtgccctttgtgcgtggatggctgcttgcaaggatgagcatccccagctggagcggcccatggctgccagaacaggagaaggcttcagtcaggtgggaagccagctgcagtgtgttgcctgatgcaggatggtgcgagaaggagctgctctcttgctctgctccctggatcgcacaaggtcttcctgagaccagaattcaagtctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaagatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaaggtattatatgtaggagttttcttttaatttattttgtgataaattaccagtttcaatcactgtagaaaagccccattatgaatttaaatttcaaggaaagggtgtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaaggcgtggggcattgggtttgctccccttgctgctgctccatccctgcaggaggctcgcgctgaggcaggaccgtgcggccatggctgctgcattcattgagcacaaaggtgcagctgcagcagcagctggagagcaagagtcacccagcctgtgcgccagaatgcagaggctcctgacctcacagccagtccctgatagaacacacgcaggagcagagtcccctccccctccaggctgccctctcaacttctccctcacctccttccctaggggtagacagagatgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcactttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacactgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccctcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgactgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgca

SEQ ID NO: 789 - RNA, 5172 nt, Homo sapiens
  source 1..5172: mol_type = unassigned RNA; note = Homo sapiens insulin like growth factor 1 receptor (IGF1R), transcript variant X4, mRNA, NCBI Reference Sequence: XM_017022139.1
aagatggtagggtaatttgaacacgattaaaagtttaaatgtcgcagaactgggactgggaacggtgagggcgtgttgtctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaa

SEQ ID NO: 790 - RNA, 4712 nt, Homo sapiens
  source 1..4712: mol_type = unassigned RNA; note = Homo sapiens insulin like growth factor 1 receptor (IGF1R), transcript variant X5, mRNA, NCBI Reference Sequence: XM_024449913.1
agtttacagactcaccctgaattattcttgcgtaagatctaagaaccctctcttggggtctggatcaggactcctttcctgtaacacacctatgttcttggacttaagaatgaccctcagacatggtgacttctttgtcatctaacagctttggcttatttgagtgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaa

SEQ ID NO: 791 - RNA, 2336 nt, Homo sapiens
  source 1..2336: mol_type = unassigned RNA; note = Homo sapiens matrix metallopeptidase 9 (MMP9), mRNA, NCBI Reference Sequence: NM_004994.3
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagcggctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaaccttta

SEQ ID NO: 792 - RNA, 5727 nt, Homo sapiens
  source 1..5727: mol_type = unassigned RNA; note = Homo sapiens coiled-coil domain containing 6 (CCDC6), mRNA, NCBI Reference Sequence: NM_005436.5
gtctgcgccctggtgccaggcgctcagctcggcgctcccctgtgctcgcccggcgcccactcattcgcagcccggccttcgtcgccgccgcctccctgctgctcctcctcctttccccagcccgccgcggccatggcggacagcgccagcgagagcgacacggacggggcggggggcaacagcagcagctcggccgccatgcagtcgtcctgctcgtcgacctcgggcggcggcggtggcggcgggggaggcggcggcggtgggaagtcggggggcattgtcatctcgccgttccgcctggaggagctcaccaaccgcctggcctcgctgcagcaagagaacaaggtgctgaagatagagctggagacctacaaactgaagtgcaaggcactgcaggaggagaaccgcgacctgcgcaaagccagcgtgaccatccaagccagggctgagcaggaagaagaattcattagtaacactttattcaagaaaattcaggctttgcagaaggagaaagaaacccttgctgtaaattatgagaaagaagaagaattcctcactaatgagctctccagaaaattgatgcagttgcagcatgagaaagccgaactagaacagcatcttgaacaagagcaggaatttcaggtcaacaaactgatgaagaaaattaaaaaactggagaatgacaccatttctaagcaacttacattagaacagttgagacgggagaagattgaccttgaaaatacattggaacaagaacaagaagcactagttaatcgcctctggaaaaggatggataagcttgaagctgaaaagcgaatcctgcaggaaaaattagaccagcccgtctctgctccaccatcgcctagagatatctccatggagattgattctccagaaaatatgatgcgtcacatcaggtttttaaagaatgaagtggaacggctgaagaagcaactgagagctgctcagttacagcattcagagaaaatggcacagtatctggaggaggaacgtcacatgagagaagagaacttgaggctccagaggaagctgcagagggagatggagagaagagaagccctctgtcgacagctctccgagagtgagtccagcttagaaatggacgacgaaaggtattttaatgagatgtctgcacaaggattaagacctcgcactgtgtccagcccgatcccttacacaccttctccgagttcaagcaggcctatatcacctggtctatcatatgcaagtcacacggttggtttcacgccaccaacttcactgactagagctggaatgtcttattacaattccccgggtcttcacgtgcagcacatgggaacatcccatggtatcacaaggccttcaccacggagaagcaacagtcctgacaaattcaaacggcccacgccgcctccatctcccaacacacagaccccagtccagccacctccgcctccacctccgccacccatgcagcccacggtcccctcagcagccacctcgcagcctactccttcgcaacattcggcgcacccctcctcccagccttaatgcatgagcttagtctgaatttcaagttgggactcatccaatggagccgtctactcaacgccaaaggcttccttctctggcatatttggatatgacttatttgcactgaggttatctaggcttcactatccattgtgttgtaaatgtttgtcagaaatgcagccagtgttgtgggtctacaacactaaccagacgactttttccatcagtgttttacttgaatcttcatgtacgtccattccctggctggaaccttcgctgtttggtatttggtatttcagcagcagtgtgcaatttttgcttggcccagagcttcattctcctggcttttaggtttgtaaaagaaaaagggatatcttttttatatttttttccatgaatctgcagaaaattactgagctgttgttaccctcctctcattataatagtgtttaccaaacataccaataattcagcactacaattcagacctttgaaaatctggctttcagtgtagaacagaaagttagatgaatcagtgcccaagacatattttctgtttaacagaactttctacagatacattttttacaggttattttcattgtgttattgacatccatgtctctcgtaaaacagatggcccaaagtaatgaatcatgtggctgtaccttctccacataaatgggatggataattatcgtatattaagatgtgattctcttttttatccttaatgttaatctacttaacctggccccctctaacatgagtcgataaatgttgtcctactcaccggtggtttcaatggctaattagaatgtgttatttgatttctgctgcagaaggcagtgtgattgtaacaaaaacaatgcggcttccccctttcgtacttcatttgtgttctcttaaaatagagtttgaacaaatattttaaaggtgcaaaataccattagaaaatactatttgaaatggacattatcgcattatcttggcataatggccagaaaatattgtattgcttggcagaaaagaaaataaggtctaaaggaaagtagcacattagcattgatggctgttcatttcacccagtataagcaagtgcagtgtacaaagaagtatattctgaatacattatttccattcatttagcacaaataaatcatttggtttcactttgcagtggaacactgagtcactcttttcttaacacgtgcaacatcttaatttttgtttttcagcagttgctgttttgtactttggtagtaaagtgatttttaccacctgtgtttgcatatttatatatgctgtggatgaaaataacttactagagaatgtatattttatgacaagaatgtgtatctgttggatataatcagagaactgaaaagtaatttatcagtaatttttaagagtccatgttttgtgacaaccatctctaatagccaactctttattaaacacactcctaaaaataaggaaccatgacattgtagatatttaatattgtacagtatagaaacctccatttttgccttcgaatgcatatttaagagttaacagaatgaaaaaaaaaagtcttgttggataatagtgtttgactagcgttttaagaacttgagagtaaaagcaacaataagattttttcacctcttcctgcttccacccccaaactgagaacatcactcaattgtttggaagaaactgtaggtctatataaattttatttataatgtatgtgtaatatacataatcataatacagttctcagatgcagggaagaagtttggcatttaatcattgaggctttaggtttttgatgtgatcagactgggccatgtcaaacccggaattttcaccaacagttcactcaccctcctggtacattgccattccaaggaattctgagagtaggcaaacaaattttgccttcatggtacagttctcagtttttcttataggagaaatatggtatatgtttataagaatcttttatgagattatagatttcaatgctgtggatagtgtcttgcacccaaacaagaaagtccataatggaatgatcttccctcagcttcctatcgatttagttacctcttgaaagcacaaaaattaaaacattgccatatgttgaatttttaaaaagcacttggagtgagcgaacatttcctgataaatgccttttagagataggttcttgatattcagacatctgcagaaatgttctggttcccaaagtcatttcacttcgaaataaaacacagctccttcaaacagcactttttccacataaatctagttgcctctccctgtggacattcagaactgatagaacaaacactactcttttgaatttgatggttcgtgtcctttaaagtgtttgaggacctatgcagagcctgtaacacttgggtagtacctgctaggacaatttcttggcaattgtcttactactagggatcagtaagatttagattctgagcccataatggcaacagccccctcacctatgggaagctgacttccctcagtcgggcacttctcatgggggctgaacatggttcctgccattctgttacccactctcccaggtgagccctggattggctcccagaaggcctttgtaaaatcagtagccgtcctgcaggcaggtgggagcaacaggggcttcagtagcttcattttcctgtcttgcagacagagacccttggctaccactgtgctgctaataggataagtactctgttgccagattaccatgccttttatacaaaaccaaattaacttacctaatacctgacacctctttgggctctgaactgctttctctcatcaagcatgctagcactctagacagaattctagaaatttggcagatagtggaagcctttaattgaacttactccttcgttgactgaaaggagttttaaattctgagctcctgagatactgactagcaaccatggaatgaatgtgtgaccagaaagtggctttgacaccaagtgctactgtccctttgtaattggcttctaacagaattcaaccagaaataattgataatgtgaatttttgttaattgttcacttgtaggaaaatagaacatgtatcaccctttgttaggtagacatgaacttttcctgcacaaagccttgcttttagagaatgcccaataaggcaagaaaaagcatagtaacttgtgctttgagagctcaatatttgtatcttatcagtacagaagaaatatttctgtgtaacttgatcttctgtctagtacttgtcttataggtaaccaacactgaaaactttgtagtgatgactaccaaagaaatacatagtaaaacaaccttttatttccaaattgttaaagagccagccattgatgctgctacatgagttccatgctcaagagccattgtaagagattaaggggtttctaggtttttggtgattttttgtttgtttttttctttgttttttagggtttttttttcttctttaattttttgattaaaacatacacacagctgttagcataaagtcgtggggggcattttctggaatgctcagcagttctgattaactgccaagcccaggttgcctctcatgaggcaactgaaaaaatcctgtgtcttgatagcatgggtgctgtgtgtgtgcatgtgtgtgtctgcattcatgccttaactcgggttactgcacaactttagttcttgacttagtctgcaccgtcatctagattgtattgtacatctcggtctgaacttcatcctggcaaaaacaaagttgcaggcacaacagtttaagaatgcattcctccagaagagtatctggtcaggttgacccctgagccttctttggacttgatttggaacttagcctggaaagcgaaagtggactgtccaacagaaagatgtcaacaaggaaaagaggagagccaagcgctagcatgccttttgcctctgcatatctgtgcacactgtatgttgttcatgatagcttgtctacaacttgactaggttggagttctggtaatagtggcaatcttgacattcttggtcagagtttagagagatgtaagactttcaattaatgtcttatttactcctttatgttgattagtctttgatacatgtgctgaatcagaaacctaaataaagataattttttaaaatgtacctcttgagccttaaa

SEQ ID NO: 793 - RNA, 3461 nt, Homo sapiens
  source 1..3461: mol_type = unassigned RNA; note = Homo sapiens nuclear receptor coactivator 4 (NCOA4), transcript variant 4, mRNA, NCBI Reference Sequence: NM_001145263.2
gtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagccata

SEQ ID NO: 794 - RNA, 3412 nt, Homo sapiens
  source 1..3412: mol_type = unassigned RNA; note = Homo sapiens nuclear receptor coactivator 4 (NCOA4), transcript variant 5, mRNA, NCBI Reference Sequence: NM_005437.4
agcctgtcgcttgccgggcagctggtgagtcggtgacctggcctgtgaggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagccata

SEQ ID NO: 795 - RNA, 3647 nt, Homo sapiens
  source 1..3647: mol_type = unassigned RNA; note = Homo sapiens nuclear receptor coactivator 4 (NCOA4), transcript variant 1, mRNA, NCBI Reference Sequence: NM_001145260.2
gtcgcgagaactctgcctttgggccgtaggttagtgtggggccgtgtctcagtccacccaaggtctcctcggatcgcctggagaggcactcggacctgttatgtctggacacattgcttcaacatagaacgcacatgaacaatgtggaggtctaggctggaatgggggcccagttgaccacttttgctctagctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacaggcatacttcaaaatgaactttcaagatgtaaccgttgggaattttcagatcccatgtggattctagtagtttatatacctacctcgaagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagccata

SEQ ID NO: 796 - RNA, 3558 nt, Homo sapiens
  source 1..3558: mol_type = unassigned RNA; note = Homo sapiens nuclear receptor coactivator 4 (NCOA4), transcript variant 2, mRNA, NCBI Reference Sequence: NM_001145261.2
gtcgcgagaactctgcctttgggccgtaggttagtgtggggccgtgtctcagtccacccaaggtctcctcggatcgcctggagaggcactcggacctgttatgtctggacacattgcttcaacatagaacgcacatgaacaatgtggaggtctaggctggaatgggggcccagttgaccacttttgctctagctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagccata

SEQ ID NO: 797 - RNA, 4040 nt, Homo sapiens
  source 1..4040: mol_type = unassigned RNA; note = Homo sapiens nuclear receptor coactivator 4 (NCOA4), transcript variant 3, mRNA, NCBI Reference Sequence: NM_001145262.2
cttggcatctgggctctgaaagctgacagtgctctaactgcgccacagggaggaggagggacagagagagccaaaggcagcaaaggggcaagcatcctgggacttaccataaagaaatgaaacagattttcttcgtggctgacagatgagttctcaagatgacttttgaaggataacactccttttaatttgaaaaaaatgtgataactgtgtgtggaaaaatcagttttgtaacttttaaatctcatcctacattctgtctatagctgataagggcaaagtccaatgtgtgaactcttgctgtagtctactcttattgtgtaatattaatacttgtgattgaattgagaggacttgctttaggaatctagtaatacagtcagcactgtatgtatttgagtttgtctcccgtatgttccggaattctggagttttgacattgtgaagcaacaatttaattttattgattcaattttacactgtgccaggcattgtggcattccacacaaatggtgagaagctaaaagtgagaaatttggcacaggtgaagaaggctgggtaacacatttgaaagactgctaaacaggtcttgcatgactggcctaagtgcaaagtgaagcagcccatcacgctccagctctccaaatcggagccggcatttcacccatgtgatacaggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagccata

SEQ ID NO: 798 - RNA, 5431 nt, Homo sapiens
  source 1..5431: mol_type = unassigned RNA; note = Homo sapiens CD44 molecule (Indian blood group) (CD44), transcript variant 1, mRNA, NCBI Reference Sequence: NM_000610.4
ctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 799 - RNA, 5302 nt, Homo sapiens
  source 1..5302: mol_type = unassigned RNA; note = Homo sapiens CD44 molecule (Indian blood group) (CD44), transcript variant 2, mRNA, NCBI Reference Sequence: NM_001001389.2
ctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 800 - RNA, 4684 nt, Homo sapiens
  source 1..4684: mol_type = unassigned RNA; note = Homo sapiens CD44 molecule (Indian blood group) (CD44), transcript variant 3, mRNA, NCBI Reference Sequence: NM_001001390.2
ctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 801 - RNA, 4288 nt, Homo sapiens
  source 1..4288: mol_type = unassigned RNA; note = Homo sapiens CD44 molecule (Indian blood group) (CD44), transcript variant 4, mRNA, NCBI Reference Sequence: NM_001001391.2
ctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 802 - RNA, 3668 nt, Homo sapiens
  source 1..3668: mol_type = unassigned RNA; note = Homo sapiens CD44 molecule (Indian blood group) (CD44), transcript variant 5, mRNA, NCBI Reference Sequence: NM_001001392.2
ctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 803 - RNA, 4492 nt, Homo sapiens
  source 1..4492: mol_type = unassigned RNA; note = Homo sapiens CD44 molecule (Indian blood group) (CD44), transcript variant 6, mRNA, NCBI Reference Sequence: NM_001202555.2
ctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 804 - RNA, 4225 nt, Homo sapiens
  source 1..4225: mol_type = unassigned RNA; note = Homo sapiens CD44 molecule (Indian blood group) (CD44), transcript variant 7, mRNA, NCBI Reference Sequence: NM_001202556.2
ctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 805 - RNA, 1959 nt, Homo sapiens
  source 1..1959: mol_type = unassigned RNA; note = Homo sapiens CD44 molecule (Indian blood group) (CD44), transcript variant 8, mRNA, NCBI Reference Sequence: NM_001202557.2
ctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaagttgaagagattcaggttatagcataagaagagcactgtttcatcgtcttcttgctgttaggaggtctatgaagcagagaagaactttcctttggaaaacaactaaatgaagacagtcacctcgctagaactgacacatgggctgtttttatattcttgaaggccactctctccctacctgaaccaagacctataggtttacatgttatttacattttatatataatatatatatatatatatacacatacattatatatacacaatagtaattctagcaacagaggaaatgacctttaacaggggtataaatctaaatttataaaagtataaatctaaatttcttacccaagacactttaaagatacattatttttctccaggacgtaattcataggaatattaagccttttgtaaatgtccctttagatggtttctcataaggtaaaagaaacttatttccaagcaggaccacctttattgtgtccccagatcacctcacagggcagaaaaatgcccctcagtctgggagaagacctagagagaattatggactccttactggtttttggaaagcaaccaacagctaattccaacaccatgggcagcccatacagtctctaattatctgagaaaatcaaatgatgctgttacaataattacgctggtacaagttaataaaagtgccatgttacagtcaaacagctatgttgctatctataccattgagggcatagttttaaaaagtagttatgctacctgattgtataaggaacaaaactgagagaaaaaatctaaaaggccgcctatgattgaatggaaagattttttttagttgaatttaaataatgtgacttgggggagcctttacaaagagtctttatacctcccttcagcttcctcattttcccttggattacttttgctcaattaaatatgaatttcc

SEQ ID NO: 806 - RNA, 5437 nt, Homo sapiens
  source 1..5437: mol_type = unassigned RNA; note = Homo sapiens CD44 molecule (Indian blood group) (CD44), transcript variant X1, mRNA, NCBI Reference Sequence: XM_005253231.3
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 807 - RNA, 5434 nt, Homo sapiens
  source 1..5434: mol_type = unassigned RNA; note = Homo sapiens CD44 molecule (Indian blood group) (CD44), transcript variant X2, mRNA, NCBI Reference Sequence: XM_005253232.3
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 808 - RNA, 5308 nt, Homo sapiens
  source 1..5308: mol_type = unassigned RNA; note = Homo sapiens CD44 molecule (Indian blood group) (CD44), transcript variant X4, mRNA, NCBI Reference Sequence: XM_005253235.3
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 809 - RNA, 4948 nt, Homo sapiens
  source 1..4948: mol_type = unassigned RNA; note = Homo sapiens CD44 molecule (Indian blood group) (CD44), transcript variant X10, mRNA, NCBI Reference Sequence: XM_005253238.3
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 810 - RNA, 4942 nt, Homo sapiens
  source 1..4942: mol_type = unassigned RNA; note = Homo sapiens CD44 molecule (Indian blood group) (CD44), transcript variant X11, mRNA, NCBI Reference Sequence: XM_005253239.3
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 811 - RNA, 4813 nt, Homo sapiens
  source 1..4813: mol_type = unassigned RNA; note = Homo sapiens CD44 molecule (Indian blood group) (CD44), transcript variant X13, mRNA, NCBI Reference Sequence: XM_005253240.3
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 812 - RNA, 5431 nt, Homo sapiens
  source 1..5431: mol_type = unassigned RNA; note = Homo sapiens CD44 molecule (Indian blood group) (CD44), transcript variant X3, mRNA, NCBI Reference Sequence: XM_006718388.2
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 813 - RNA, 1470 nt, Homo sapiens
  source 1..1470: mol_type = unassigned RNA; note = Homo sapiens CD44 molecule (Indian blood group) (CD44), transcript variant X19, mRNA, NCBI Reference Sequence: XM_006718390.4
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccattatctgcctcttcacccggaggatctacaaacagcacacagtgactaagtccctgggctttcaagtgcagagggatactacagactgcatggatgggcaaaatggcgcctttggttatcctcggtggagggctggtgttttcaaagctgtccttcctactgctgcagcttctttgactgttttatctggaagatctcatgttctgaaccccaaggtattctatgacagaatgcaaaggacactgagatgcttaccaatatggctgaattaagctgaagtcaccctccgctttccctccatttccatgcagccatctatacaacctggtatagatgattcattgcatagcctacagaagcaagactatgtgcgggacaagtggcgaaggctcaagaaataacatttttctaa

SEQ ID NO: 814 - RNA, 5233 nt, Homo sapiens
  source 1..5233: mol_type = unassigned RNA; note = Homo sapiens CD44 molecule (Indian blood group) (CD44), transcript variant X6, mRNA, NCBI Reference Sequence: XM_011520482.2
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 815 - RNA, 5182 nt, Homo sapiens
  source 1..5182: mol_type = unassigned RNA; note = Homo sapiens CD44 molecule (Indian blood group) (CD44), transcript variant X7, mRNA, NCBI Reference Sequence: XM_011520483.2
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 816 - RNA, 5179 nt, Homo sapiens
  source 1..5179: mol_type = unassigned RNA; note = Homo sapiens CD44 molecule (Indian blood group) (CD44), transcript variant X8, mRNA, NCBI Reference Sequence: XM_011520484.2
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 817 - RNA, 5176 nt, Homo sapiens
  source 1..5176: mol_type = unassigned RNA; note = Homo sapiens CD44 molecule (Indian blood group) (CD44), transcript variant X9, mRNA, NCBI Reference Sequence: XM_011520485.2
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 818 - RNA, 4819 nt, Homo sapiens
  source 1..4819: mol_type = unassigned RNA; note = Homo sapiens CD44 molecule (Indian blood group) (CD44), transcript variant X12, mRNA, NCBI Reference Sequence: XM_011520486.2
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccacagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 819 - RNA, 1684 nt, Homo sapiens
  source 1..1684: mol_type = unassigned RNA; note = Homo sapiens CD44 molecule (Indian blood group) (CD44), transcript variant X15, mRNA, NCBI Reference Sequence: XM_011520487.3
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaa

SEQ ID NO: 820 - RNA, 4483 nt, Homo sapiens
  source 1..4483: mol_type = unassigned RNA; note = Homo sapiens CD44 molecule (Indian blood group) (CD44), transcript variant X16, mRNA, NCBI Reference Sequence: XM_011520488.2
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 821 - RNA, 1552 nt, Homo sapiens
  source 1..1552: mol_type = unassigned RNA; note = Homo sapiens CD44 molecule (Indian blood group) (CD44), transcript variant X18, mRNA, NCBI Reference Sequence: XM_011520489.3
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaa

SEQ ID NO: 822 - RNA, 5305 nt, Homo sapiens
  source 1..5305: mol_type = unassigned RNA; note = Homo sapiens CD44 molecule (Indian blood group) (CD44), transcript variant X5, mRNA, NCBI Reference Sequence: XM_017018583.2
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 823 - RNA, 4546 nt, Homo sapiens
  source 1..4546: mol_type = unassigned RNA; note = Homo sapiens CD44 molecule (Indian blood group) (CD44), transcript variant X14, mRNA, NCBI Reference Sequence: XM_017018584.2
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 824 - RNA, 4417 nt, Homo sapiens
  source 1..4417: mol_type = unassigned RNA; note = Homo sapiens CD44 molecule (Indian blood group) (CD44), transcript variant X17, mRNA, NCBI Reference Sequence: XM_017018585.2
agcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 825 - RNA, 110 nt, Homo sapiens
  source 1..110: mol_type = unassigned RNA; note = Homo sapiens microRNA 34a (MIR34A), microRNA, NCBI Reference Sequence: NR_029610.1
ggccagctgtgagtgtttctttggcagtgtcttagctggttgttgtgagcaatagtaaggaagcaatcagcaagtatactgccctagaagtgctgcacgttgtggggccc

SEQ ID NO: 826 - RNA, 84 nt, Homo sapiens
  source 1..84: mol_type = unassigned RNA; note = Homo sapiens microRNA 34b (MIR34B), microRNA, NCBI Reference Sequence: NR_029839.1
gtgctcggtttgtaggcagtgtcattagctgattgtactgtggtggttacaatcactaactccactgccatcaaaacaaggcac

SEQ ID NO: 827 - RNA, 77 nt, Homo sapiens
  source 1..77: mol_type = unassigned RNA; note = Homo sapiens microRNA 34c (MIR34C), microRNA, NCBI Reference Sequence: NR_029840.1
agtctagttactaggcagtgtagttagctgattgctaatagtaccaatcactaaccacacggccaggtaaaaagatt

SEQ ID NO: 828 - RNA, 90 nt, Homo sapiens
  source 1..90: mol_type = unassigned RNA; note = Homo sapiens microRNA 200a (MIR200A), microRNA, NCBI Reference Sequence: NR_029834.1
ccgggcccctgtgagcatcttaccggacagtgctggatttcccagcttgactctaacactgtctggtaacgatgttcaaaggtgacccgc

SEQ ID NO: 829 - RNA, 95 nt, Homo sapiens
  source 1..95: mol_type = unassigned RNA; note = Homo sapiens microRNA 200b (MIR200B), microRNA, NCBI Reference Sequence: NR_029639.1
ccagctcgggcagccgtggccatcttactgggcagcattggatggagtcaggtctctaatactgcctggtaatgatgacggcggagccctgcacg

SEQ ID NO: 830 - RNA, 68 nt, Homo sapiens
  source 1..68: mol_type = unassigned RNA; note = Homo sapiens microRNA 200c (MIR200C), microRNA, NCBI Reference Sequence: NR_029779.1
ccctcgtcttacccagcagtgtttgggtgcggttgggagtctctaatactgccgggtaatgatggagg

SEQ ID NO: 831 - RNA, 77 nt, Homo sapiens
  source 1..77: mol_type = unassigned RNA; note = Homo sapiens microRNA 26a-1 (MIR26A1), microRNA, NCBI Reference Sequence: NR_029499.1
gtggcctcgttcaagtaatccaggataggctgtgcaggtcccaatgggcctattcttggttacttgcacggggacgc

SEQ ID NO: 832 - RNA, 124 nt, Homo sapiens
  source 1..124: mol_type = unassigned RNA; note = Homo sapiens microRNA 506 (MIR506), microRNA, NCBI Reference Sequence: NR_030233.1
gccaccaccatcagccatactatgtgtagtgccttattcaggaaggtgttacttaatagattaatatttgtaaggcacccttctgagtagagtaatgtgcaacatggacaacatttgtggtggc

SEQ ID NO: 833 - RNA, 85 nt, Homo sapiens
  source 1..85: mol_type = unassigned RNA; note = Homo sapiens microRNA 520a (MIR520A), microRNA, NCBI Reference Sequence: NR_030189.1
ctcaggctgtgaccctccagagggaagtactttctgttgtctgagagaaaagaaagtgcttccctttggactgtttcggtttgag

SEQ ID NO: 834 - RNA, 61 nt, Homo sapiens
  source 1..61: mol_type = unassigned RNA; note = Homo sapiens microRNA 520b (MIR520B), microRNA NCBI Reference Sequence: NR_030195.1
ccctctacagggaagcgctttctgttgtctgaaagaaaagaaagtgcttccttttagaggg

SEQ ID NO: 835 - RNA, 87 nt, Homo sapiens
  source 1..87: mol_type = unassigned RNA; note = Homo sapiens microRNA 520c (MIR520C), microRNANCBI Reference Sequence: NR_030198.1
tctcaggctgtcgtcctctagagggaagcactttctgttgtctgaaagaaaagaaagtgcttccttttagagggttaccgtttgaga

SEQ ID NO: 836 - RNA, 87 nt, Homo sapiens
  source 1..87: mol_type = unassigned RNA; note = Homo sapiens microRNA 520d (MIR520D), microRNA, NCBI Reference Sequence: NR_030204.1
tctcaagctgtgagtctacaaagggaagccctttctgttgtctaaaagaaaagaaagtgcttctctttggtgggttacggtttgaga

SEQ ID NO: 837 - RNA, 87 nt, Homo sapiens
  source 1..87: mol_type = unassigned RNA; note = Homo sapiens microRNA 520e (MIR520E), microRNANCBI Reference Sequence: NR_030183.1
tctcctgctgtgaccctcaagatggaagcagtttctgttgtctgaaaggaaagaaagtgcttcctttttgagggttactgtttgaga

SEQ ID NO: 838 - RNA, 87 nt, Homo sapiens
  source 1..87: mol_type = unassigned RNA; note = Homo sapiens microRNA 520f (MIR520F), microRNA, NCBI Reference Sequence: NR_030186.1
tctcaggctgtgaccctctaaagggaagcgctttctgtggtcagaaagaaaagcaagtgcttccttttagagggttaccgtttggga

SEQ ID NO: 839 - RNA, 90 nt, Homo sapiens
  source 1..90: mol_type = unassigned RNA; note = Homo sapiens microRNA 520g (MIR520G), microRNA, NCBI Reference Sequence: NR_030206.1
tcccatgctgtgaccctctagaggaagcactttctgtttgttgtctgagaaaaaacaaagtgcttccctttagagtgttaccgtttggga

SEQ ID NO: 840 - RNA, 88 nt, Homo sapiens
  source 1..88: mol_type = unassigned RNA; note = Homo sapiens microRNA 520h (MIR520H), microRNA, NCBI Reference Sequence: NR_030215.1
tcccatgctgtgaccctctagaggaagcactttctgtttgttgtctgagaaaaaacaaagtgcttccctttagagttactgtttggga

SEQ ID NO: 841 - RNA, 83 nt, Homo sapiens
  source 1..83: mol_type = unassigned RNA; note = Homo sapiens microRNA 15a (MIR15A), microRNA, NCBI Reference Sequence: NR_029485.1
ccttggagtaaagtagcagcacataatggtttgtggattttgaaaaggtgcaggccatattgtgctgcctcaaaaatacaagg

SEQ ID NO: 842 - RNA, 98 nt, Homo sapiens
  source 1..98: mol_type = unassigned RNA; note = Homo sapiens microRNA 15b (MIR15B), microRNA, NCBI Reference Sequence: NR_029663.1
ttgaggccttaaagtactgtagcagcacatcatggtttacatgctacagtcaagatgcgaatcattatttgctgctctagaaatttaaggaaattcat

SEQ ID NO: 843 - RNA, 89 nt, Homo sapiens
  source 1..89: mol_type = unassigned RNA; note = Homo sapiens microRNA 16-1 (MIR16-1), microRNA, NCBI Reference Sequence: NR_029486.1
gtcagcagtgccttagcagcacgtaaatattggcgttaagattctaaaattatctccagtattaactgtgctgctgaagtaaggttgac

SEQ ID NO: 844 - RNA, 81 nt, Homo sapiens
  source 1..81: mol_type = unassigned RNA; note = Homo sapiens microRNA 16-2 (MIR16-2), microRNA, NCBI Reference Sequence: NR_029525.1
gttccactctagcagcacgtaaatattggcgtagtgaaatatatattaaacaccaatattactgtgctgctttagtgtgac

SEQ ID NO: 845 - RNA, 110 nt, Homo sapiens
  source 1..110: mol_type = unassigned RNA; note = Homo sapiens microRNA 10b (MIR10B), microRNA, NCBI Reference Sequence: NR_029609.1
ccagaggttgtaacgttgtctatatataccctgtagaaccgaatttgtgtggtatccgtatagtcacagattcgattctaggggaatatatggtcgatgcaaaaacttca

SEQ ID NO: 846 - RNA, 110 nt, Homo sapiens
  source 1..110: mol_type = unassigned RNA; note = Homo sapiens microRNA 221 (MIR221), microRNA, NCBI Reference Sequence: NR_029635.1
tgaacatccaggtctggggcatgaacctggcatacaatgtagatttctgtgttcgttaggcaacagctacattgtctgctgggtttcaggctacctggaaacatgttctc

SEQ ID NO: 847 - RNA, 65 nt, Homo sapiens
  source 1..65: mol_type = unassigned RNA; note = Homo sapiens microRNA 155 (MIR155), microRNA, NCBI Reference Sequence: NR_030784.1
ctgttaatgctaatcgtgataggggtttttgcctccaactgactcctacatattagcattaacag

SEQ ID NO: 848 - RNA, 97 nt, Homo sapiens
  source 1..97: mol_type = unassigned RNA; note = Homo sapiens microRNA 630 (MIR630), microRNA, NCBI Reference Sequence: NR_030359.1
aacttaacatcatgctacctctttgtatcatattttgttattctggtcacagaatgacctagtattctgtaccagggaaggtagttcttaactatat

SEQ ID NO: 849 - RNA, 80 nt, Homo sapiens
  source 1..80: mol_type = unassigned RNA; note = Homo sapiens microRNA let-7a-1 (MIRLET7A1), microRNA, NCBI Reference Sequence: NR_029476.1
tgggatgaggtagtaggttgtatagttttagggtcacacccaccactgggagataactatacaatctactgtctttccta

SEQ ID NO: 850 - RNA, 87 nt, Homo sapiens
  source 1..87: mol_type = unassigned RNA; note = Homo sapiens microRNA let-7f-1 (MIRLET7F1), microRNA, NCBI Reference Sequence: NR_029483.1
tcagagtgaggtagtagattgtatagttgtggggtagtgattttaccctgttcaggagataactatacaatctattgccttccctga

SEQ ID NO: 851 - RNA, 87 nt, Homo sapiens
  source 1..87: mol_type = unassigned RNA; note = Homo sapiens microRNA let-7d (MIRLET7D), microRNA, NCBI Reference Sequence: NR_029481.1
cctaggaagaggtagtaggttgcatagttttagggcagggattttgcccacaaggaggtaactatacgacctgctgcctttcttagg

SEQ ID NO: 852 - RNA, 78 nt, Homo sapiens
  source 1..78: mol_type = unassigned RNA; note = Homo sapiens microRNA 27a (MIR27A), microRNA, NCBI Reference Sequence: NR_029501.1
ctgaggagcagggcttagctgcttgtgagcagggtccacaccaagtcgtgttcacagtggctaagttccgccccccag

SEQ ID NO: 853 - RNA, 71 nt, Homo sapiens
  source 1..71: mol_type = unassigned RNA; note = Homo sapiens microRNA 31 (MIR31), microRNA, NCBI Reference Sequence: NR_029505.1
ggagaggaggcaagatgctggcatagctgttgaactgggaacctgctatgccaacatattgccatctttcc

SEQ ID NO: 854 - RNA, 78 nt, Homo sapiens
  source 1..78: mol_type = unassigned RNA; note = Homo sapiens microRNA 96 (MIR96), microRNA, NCBI Reference Sequence: NR_029512.1
tggccgattttggcactagcacatttttgcttgtgtctctccgctctgagcaatcatgtgcagtgccaatatgggaaa

SEQ ID NO: 855 - RNA, 119 nt, Homo sapiens
  source 1..119: mol_type = unassigned RNA; note = Homo sapiens microRNA 98 (MIR98), microRNA, NCBI Reference Sequence: NR_029513.1
aggattctgctcatgccagggtgaggtagtaagttgtattgttgtggggtagggatattaggccccaattagaagataactatacaacttactactttccctggtgtgtggcatattca

SEQ ID NO: 856 - RNA, 110 nt, Homo sapiens
  source 1..110: mol_type = unassigned RNA; note = Homo sapiens microRNA 182 (MIR182), microRNA, NCBI Reference Sequence: NR_029614.1
gagctgcttgcctccccccgtttttggcaatggtagaactcacactggtgaggtaacaggatccggtggttctagacttgccaactatggggcgaggactcagccggcac

SEQ ID NO: 857 - RNA, 110 nt, Homo sapiens
  source 1..110: mol_type = unassigned RNA; note = Homo sapiens microRNA 205 (MIR205), microRNA, NCBI Reference Sequence: NR_029622.1
aaagatcctcagacaatccatgtgcttctcttgtccttcattccaccggagtctgtctcatacccaaccagatttcagtggagtgaagttcaggaggcatggagctgaca

SEQ ID NO: 858 - RNA, 80 nt, Homo sapiens
  source 1..80: mol_type = unassigned RNA; note = Homo sapiens microRNA 93 (MIR93), microRNA, NCBI Reference Sequence: NR_029510.1
ctgggggctccaaagtgctgttcgtgcaggtagtgtgattacccaacctactgctgagctagcacttcccgagcccccgg

SEQ ID NO: 859 - RNA, 64 nt, Homo sapiens
  source 1..64: mol_type = unassigned RNA; note = Homo sapiens microRNA 375 (MIR375), microRNA, NCBI Reference Sequence: NR_029867.1
ccccgcgacgagcccctcgcacaaaccggacctgagcgttttgttcgttcggctcgcgtgaggc

SEQ ID NO: 860 - RNA, 84 nt, Homo sapiens
  source 1..84: mol_type = unassigned RNA; note = Homo sapiens microRNA 25 (MIR25), microRNA, NCBI Reference Sequence: NR_029498.1
ggccagtgttgagaggcggagacttgggcaattgctggacgctgccctgggcattgcacttgtctcggtctgacagtgccggcc

SEQ ID NO: 861 - RNA, 82 nt, Homo sapiens
  source 1..82: mol_type = unassigned RNA; note = Homo sapiens microRNA 106b (MIR106B), microRNA, NCBI Reference Sequence: NR_029831.1
cctgccggggctaaagtgctgacagtgcagatagtggtcctctccgtgctaccgcactgtgggtacttgctgctccagcagg

SEQ ID NO: 862 - RNA, 84 nt, Homo sapiens
  source 1..84: mol_type = unassigned RNA; note = Homo sapiens microRNA 512-1 (MIR512-1), microRNA, NCBI Reference Sequence: NR_030180.1
tctcagtctgtggcactcagccttgagggcactttctggtgccagaatgaaagtgctgtcatagctgaggtccaatgactgagg

SEQ ID NO: 863 - RNA, 98 nt, Homo sapiens
  source 1..98: mol_type = unassigned RNA; note = Homo sapiens microRNA 512-2 (MIR512-2), microRNA, NCBI Reference Sequence: NR_030181.1
ggtacttctcagtctgtggcactcagccttgagggcactttctggtgccagaatgaaagtgctgtcatagctgaggtccaatgactgaggcgagcacc

SEQ ID NO: 864 - RNA, 83 nt, Homo sapiens
  source 1..83: mol_type = unassigned RNA; note = Homo sapiens microRNA 324 (MIR324), microRNA, NCBI Reference Sequence: NR_029896.1
ctgactatgcctccccgcatcccctagggcattggtgtaaagctggagacccactgccccaggtgctgctgggggttgtagtc

SEQ ID NO: 865 - RNA, 87 nt, Homo sapiens
  source 1..87: mol_type = unassigned RNA; note = Homo sapiens microRNA 195 (MIR195), microRNA, NCBI Reference Sequence: NR_029712.1
agcttccctggctctagcagcacagaaatattggcacagggaagcgagtctgccaatattggctgtgctgctccaggcagggtggtg

SEQ ID NO: 866 - RNA, 71 nt, Homo sapiens
  source 1..71: mol_type = unassigned RNA; note = Homo sapiens microRNA 18a (MIR18A), microRNA, NCBI Reference Sequence: NR_029488.1
tgttctaaggtgcatctagtgcagatagtgaagtagattagcatctactgccctaagtgctccttctggca

SEQ ID NO: 867 - RNA, 84 nt, Homo sapiens
  source 1..84: mol_type = unassigned RNA; note = Homo sapiens microRNA 26a-2 (MIR26A2), microRNA, NCBI Reference Sequence: NR_029847.1
ggctgtggctggattcaagtaatccaggataggctgtttccatctgtgaggcctattcttgattacttgtttctggaggcagct

SEQ ID NO: 868 - RNA, 75 nt, Homo sapiens
  source 1..75: mol_type = unassigned RNA; note = Homo sapiens microRNA 101-1 (MIR101-1), microRNA, NCBI Reference Sequence: NR_029516.1
tgccctggctcagttatcacagtgctgatgctgtctattctaaaggtacagtactgtgataactgaaggatggca

SEQ ID NO: 869 - RNA, 79 nt, Homo sapiens
  source 1..79: mol_type = unassigned RNA; note = Homo sapiens microRNA 101-2 (MIR101-2), microRNA, NCBI Reference Sequence: NR_029836.1
actgtcctttttcggttatcatggtaccgatgctgtatatctgaaaggtacagtactgtgataactgaagaatggtggt

SEQ ID NO: 870 - RNA, 88 nt, Homo sapiens
  source 1..88: mol_type = unassigned RNA; note = Homo sapiens microRNA 145 (MIR145), microRNA, NCBI Reference Sequence: NR_029686.1
caccttgtcctcacggtccagttttcccaggaatcccttagatgctaagatggggattcctggaaatactgttcttgaggtcatggtt

SEQ ID NO: 871 - RNA, 94 nt, Homo sapiens
  source 1..94: mol_type = unassigned RNA; note = Homo sapiens microRNA 331 (MIR331), microRNA, NCBI Reference Sequence: NR_029895.1
gagtttggttttgtttgggtttgttctaggtatggtcccagggatcccagatcaaaccaggcccctgggcctatcctagaaccaacctaagctc

SEQ ID NO: 872 - RNA, 81 nt, Homo sapiens
  source 1..81: mol_type = unassigned RNA; note = Homo sapiens microRNA 29b-1 (MIR29B1), microRNA, NCBI Reference Sequence: NR_029517.1
cttcaggaagctggtttcatatggtggtttagatttaaatagtgattgtctagcaccatttgaaatcagtgttcttggggg

SEQ ID NO: 873 - RNA, 81 nt, Homo sapiens
  source 1..81: mol_type = unassigned RNA; note = Homo sapiens microRNA 29b-2 (MIR29B2), microRNA, NCBI Reference Sequence: NR_029518.1
cttctggaagctggtttcacatggtggcttagatttttccatctttgtatctagcaccatttgaaatcagtgttttaggag

SEQ ID NO: 874 - RNA, 110 nt, Homo sapiens
  source 1..110: mol_type = unassigned RNA; note = Homo sapiens microRNA 7-1 (MIR7-1), microRNA, NCBI Reference Sequence: NR_029605.1
ttggatgttggcctagttctgtgtggaagactagtgattttgttgtttttagataactaaatcgacaacaaatcacagtctgccatatggcacaggccatgcctctacag

SEQ ID NO: 875 - RNA, 110 nt, Homo sapiens
  source 1..110: mol_type = unassigned RNA; note = Homo sapiens microRNA 7-2 (MIR7-2), microRNA, NCBI Reference Sequence: NR_029606.1
ctggatacagagtggaccggctggccccatctggaagactagtgattttgttgttgtcttactgcgctcaacaacaaatcccagtctacctaatggtgccagccatcgca

SEQ ID NO: 876 - RNA, 110 nt, Homo sapiens
  source 1..110: mol_type = unassigned RNA; note = Homo sapiens microRNA 7-3 (MIR7-3), microRNA, NCBI Reference Sequence: NR_029607.1
agattagagtggctgtggtctagtgctgtgtggaagactagtgattttgttgttctgatgtactacgacaacaagtcacagccggcctcatagcgcagactcccttcgac

SEQ ID NO: 877 - RNA, 69 nt, Homo sapiens
  source 1..69: mol_type = unassigned RNA; note = Homo sapiens microRNA 33a (MIR33A), microRNA, NCBI Reference Sequence: NR_029507.1
ctgtggtgcattgtagttgcattgcatgttctggtggtacccatgcaatgtttccacagtgcatcacag

SEQ ID NO: 878 - RNA, 72 nt, Homo sapiens
  source 1..72: mol_type = unassigned RNA; note = Homo sapiens microRNA 21 (MIR21), microRNA, NCBI Reference Sequence: NR_029493.1
tgtcgggtagcttatcagactgatgttgactgttgaatctcatggcaacaccagtcgatgggctgtctgaca

SEQ ID NO: 879 - RNA, 110 nt, Homo sapiens
  source 1..110: mol_type = unassigned RNA; note = Homo sapiens microRNA 203a (MIR203A), microRNA, NCBI Reference Sequence: NR_029620.1
gtgttggggactcgcgcgctgggtccagtggttcttaacagttcaacagttctgtagcgcaattgtgaaatgtttaggaccactagacccggcgggcgcggcgacagcga

SEQ ID NO: 880 - RNA, 86 nt, Homo sapiens
  source 1..86: mol_type = unassigned RNA; note = Homo sapiens microRNA 203b (MIR203B), microRNA, NCBI Reference Sequence: NR_039859.1
gcgcccgccgggtctagtggtcctaaacatttcacaattgcgctacagaactgttgaactgttaagaaccactggacccagcgcgc

SEQ ID NO: 881 - RNA, 70 nt, Homo sapiens
  source 1..70: mol_type = unassigned RNA; note = Homo sapiens microRNA 4711 (MIR4711), microRNA, NCBI Reference Sequence: NR_039861.1
aaatgtgcatcaggccagaagacatgagccctttggaaaggtctcgtgtcttctggcttgatgcacattt

SEQ ID NO: 882 - RNA, 70 nt, Homo sapiens
  source 1..70: mol_type = unassigned RNA; note = Homo sapiens microRNA 4689 (MIR4689), microRNA, NCBI Reference Sequence: NR_039838.1
ggtttctccttgaggagacatggtgggggccggtcaggcagcccatgccatgtgtcctcatggagaggcc

SEQ ID NO: 883 - RNA, 85 nt, Homo sapiens
  source 1..85: mol_type = unassigned RNA; note = Homo sapiens microRNA 122 (MIR122), microRNANCBI Reference Sequence: NR_029667.1
ccttagcagagctgtggagtgtgacaatggtgtttgtgtctaaactatcaaacgccattatcacactaaatagctactgctaggc

SEQ ID NO: 884 - RNA, 22 nt, Homo sapiens
  source 1..22: mol_type = unassigned RNA; note = Homo sapiens Mature microRNA Product hsa-miR-10b-5p
acagattcgattctaggggaat

SEQ ID NO: 885 - RNA, 22 nt, Homo sapiens
  source 1..22: mol_type = unassigned RNA; note = Homo sapiens Mature microRNA Product hsa-miR-10b-3p
caatcagcaagtatactgccct

SEQ ID NO: 886 - RNA, 22 nt, Homo sapiens
  source 1..22: mol_type = unassigned RNA; note = Homo sapiens Mature microRNA Product hsa-miR-221-5p
acctggcatacaatgtagattt

SEQ ID NO: 887 - RNA, 23 nt, Homo sapiens
  source 1..23: mol_type = unassigned RNA; note = Homo sapiens Mature microRNA Product hsa-miR-221-3p
agctacattgtctgctgggtttc

SEQ ID NO: 888 - RNA, 24 nt, Homo sapiens
  source 1..24: mol_type = unassigned RNA; note = Homo sapiens Mature microRNA Product hsa-miR-155-5p
ttaatgctaatcgtgataggggtt

SEQ ID NO: 889 - RNA, 22 nt, Homo sapiens
  source 1..22: mol_type = unassigned RNA; note = Homo sapiens Mature microRNA Product hsa-miR-155-3p
ctcctacatattagcattaaca

SEQ ID NO: 890 - RNA, 22 nt, Homo sapiens
  source 1..22: mol_type = unassigned RNA; note = Homo sapiens Mature microRNA Product hsa-miR-630
agtattctgtaccagggaaggt

SEQ ID NO: 891 - RNA, 22 nt, Homo sapiens
  source 1..22: mol_type = unassigned RNA; note = Homo sapiens Mature microRNA Product hsa-miR-27a-5p
agggcttagctgcttgtgagca

SEQ ID NO: 892 - RNA, 21 nt, Homo sapiens
  source 1..21: mol_type = unassigned RNA; note = Homo sapiens Mature microRNA Product hsa-miR-27a-3p
ttcacagtggctaagttccgc

SEQ ID NO: 893 - RNA, 23 nt, Homo sapiens
  source 1..23: mol_type = unassigned RNA; note = Homo sapiens Mature microRNA Product hsa-miR-96-5p
tttggcactagcacatttttgct

SEQ ID NO: 894 - RNA, 22 nt, Homo sapiens
  source 1..22: mol_type = unassigned RNA; note = Homo sapiens Mature microRNA Product hsa-miR-96-3p
aatcatgtgcagtgccaatatg

SEQ ID NO: 895 - RNA, 24 nt, Homo sapiens
  source 1..24: mol_type = unassigned RNA; note = Homo sapiens Mature microRNA Product hsa-miR-182-5p
tttggcaatggtagaactcacact

SEQ ID NO: 896 - RNA, 21 nt, Homo sapiens
  source 1..21: mol_type = unassigned RNA; note = Homo sapiens Mature microRNA Product hsa-miR-182-3p
tggttctagacttgccaacta

SEQ ID NO: 897 - RNA, 23 nt, Homo sapiens
  source 1..23: mol_type = unassigned RNA; note = Homo sapiens Mature microRNA Product hsa-miR-93-5p
caaagtgctgttcgtgcaggtag

SEQ ID NO: 898 - RNA, 22 nt, Homo sapiens
  source 1..22: mol_type = unassigned RNA; note = Homo sapiens Mature microRNA Product hsa-miR-93-3p
actgctgagctagcacttcccg

SEQ ID NO: 899 - RNA, 23 nt, Homo sapiens
  source 1..23: mol_type = unassigned RNA; note = Homo sapiens Mature microRNA Product hsa-miR-375-5p
gcgacgagcccctcgcacaaacc

SEQ ID NO: 900 - RNA, 22 nt, Homo sapiens
  source 1..22: mol_type = unassigned RNA; note = Homo sapiens Mature microRNA Product hsa-miR-375-3p
tttgttcgttcggctcgcgtga

SEQ ID NO: 901 - RNA, 21 nt, Homo sapiens
  source 1..21: mol_type = unassigned RNA; note = Homo sapiens Mature microRNA Product hsa-miR-25-5p
aggcggagacttgggcaattg

SEQ ID NO: 902 - RNA, 22 nt, Homo sapiens
  source 1..22: mol_type = unassigned RNA; note = Homo sapiens Mature microRNA Product hsa-miR-25-3p
cattgcacttgtctcggtctga

SEQ ID NO: 903 - RNA, 21 nt, Homo sapiens
  source 1..21: mol_type = unassigned RNA; note = Homo sapiens Mature microRNA Product hsa-miR-106b-5p
taaagtgctgacagtgcagat

SEQ ID NO: 904 - RNA, 22 nt, Homo sapiens
  source 1..22: mol_type = unassigned RNA; note = Homo sapiens Mature microRNA Product hsa-miR-106b-3p
ccgcactgtgggtacttgctgc

SEQ ID NO: 905 - RNA, 23 nt, Homo sapiens
  source 1..23: mol_type = unassigned RNA; note = Homo sapiens Mature microRNA Product hsa-miR-512-5p
cactcagccttgagggcactttc

SEQ ID NO: 906 - RNA, 22 nt, Homo sapiens
  source 1..22: mol_type = unassigned RNA; note = Homo sapiens Mature microRNA Product hsa-miR-512-3p
aagtgctgtcatagctgaggtc

SEQ ID NO: 907 - RNA, 23 nt, Homo sapiens
  source 1..23: mol_type = unassigned RNA; note = Homo sapiens Mature microRNA Product hsa-miR-520d-3p
taaggtgcatctagtgcagatag

SEQ ID NO: 908 - RNA, 23 nt, Homo sapiens
  source 1..23: mol_type = unassigned RNA; note = Homo sapiens Mature microRNA Product hsa-miR-520e-5p
actgccctaagtgctccttctgg

SEQ ID NO: 909 - protein, 372 aa, Homo sapiens
  source 1..372: note = Homo sapiens Cyclin-dependent kinase 9
MAKQYDSVECPFCDEVSKYEKLAKIGQGTFGEVFKARHRKTGQKVALKKVLMENEKEGFPITALREIKILQLLKHENVVNLIEICRTKASPYNRCKGSIYLVFDFCEHDLAGLLSNVLVKFTLSEIKRVMQMLLNGLYYIHRNKILHRDMKAANVLITRDGVLKLADFGLARAFSLAKNSQPNRYTNRVVTLWYRPPELLLGERDYGPPIDLWGAGCIMAEMWTRSPIMQGNTEQHQLALISQLCGSITPEVWPNVDNYELYEKLELVKGQKRKVKDRLKAYVRDPYALDLIDKLLVLDPAQRIDSDDALNHDFFWSDPMPSDLKGMLSTHLTSMFEYLAPPRRKGSQITQQSTNQSRNPATTNQTEFERVF

SEQ ID NO: 910 - protein, 525 aa, Homo sapiens
  source 1..525: note = Homo sapiens Histidine-rich glycoprotein
MKALIAALLLITLQYSCAVSPTDCSAVEPEAEKALDLINKRRRDGYLFQLLRIADAHLDRVENTTVYYLVLDVQESDCSVLSRKYWNDCEPPDSRRPSEIVIGQCKVIATRHSHESQDLRVIDFNCTTSSVSSALANTKDSPVLIDFFEDTERYRKQANKALEKYKEENDDFASFRVDRIERVARVRGGEGTGYFVDFSVRNCPRHHFPRHPNVFGFCRADLFYDVEALDLESPKNLVINCEVFDPQEHENINGVPPHLGHPFHWGGHERSSTTKPPFKPHGSRDHHHPHKPHEHGPPPPPDERDHSHGPPLPQGPPPLLPMSCSSCQHATFGTNGAQRHSHNNNSSDLHPHKHHSHEQHPHGHHPHAHHPHEHDTHRQHPHGHHPHGHHPHGHHPHGHHPHGHHPHCHDFQDYGPCDPPPHNQGHCCHGHGPPPGHLRRRGPGKGPRPFHCRQIGSVYRLPPLRKGEVLPLPEANFPSFPLPHHKHPLKPDNQPFPQSVSESCPGKFKSGFPQVSMFFTHTFPK

SEQ ID NO: 911 - protein, 188 aa, Homo sapiens [sequence omitted]

SEQ ID NO: 912 - protein, 187 aa, Homo sapiens
  source 1..187: note = Homo sapiens Interferon beta
MTNKCLLQIALLLCFSTTALSMSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 913 - protein, 166 aa, Homo sapiens
  source 1..166: note = Homo sapiens Interferon gamma
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 914 - protein, 200 aa, Homo sapiens
  source 1..200: note = Homo sapiens Interferon lambda-2
MKLDMTGDCTPVLVLMAAVLTVTGAVPVARLHGALPDARGCHIAQFKSLSPQELQAFKRAKDALEESLLLKDCRCHSRLFPRTWDLRQLQVRERPMALEAELALTLKVLEATADTDPALVDVLDQPLHTLHHILSQFRACIQPQPTAGPRTRGRLHHWLYRLQEAPKKESPGCLEASVTFNLFRLLTRDLNCVASGDLCV

SEQ ID NO: 915 - protein, 196 aa, Homo sapiens
  source 1..196: note = Homo sapiens Interferon lambda-3
MTGDCMPVLVLMAAVLTVTGAVPVARLRGALPDARGCHIAQFKSLSPQELQAFKRAKDALEESLLLKDCKCRSRLFPRTWDLRQLQVRERPVALEAELALTLKVLEATADTDPALGDVLDQPLHTLHHILSQLRACIQPQPTAGPRTRGRLHHWLHRLQEAPKKESPGCLEASVTFNLFRLLTRDLNCVASGDLCV

SEQ ID NO: 916 - protein, 243 aa, Homo sapiens
  source 1..243: note = Homo sapiens Interleukin-27 subunit alpha
MGQTAGDLGWRLSLLLLPLLLVQAGVWGFPRPPGRPQLSLQELRREFTVSLHLARKLLSEVRGQAHRFAESHLPGVNLYLLPLGEQLPDVSLTFQAWRRLSDPERLCFISTTLQPFHALLGGLGTQGRWTNMERMQLWAMRLDLRDLQRHLRFQVLAAGFNLPEEEEEEEEEEEEERKGLLPGALGSALQGPAQVSWPQLLSTYRLLHSLELVLSRAVRELLLLSKAGHSVWPLGFPTLSPQP

SEQ ID NO: 917 - protein, 229 aa, Homo sapiens
  source 1..229: note = Homo sapiens Interleukin-27 subunit beta
MTPQLLLALVLWASCPPCSGRKGPPAALTLPRVQCRASRYPIAVDCSWTLPPAPNSTSPVSFIATYRLGMAARGHSWPCLQQTPTSTSCTITDVQLFSMAPYVLNVTAVHPWGSSSSFVPFITEHIIKPDPPEGVRLSPLAERQLQVQWEPPGSWPFPEIFSLKYWIRYKRQGAARFHRVGPIEATSFILRAVRPRARYYVQVAAQDLTDYGELSDWSLPATATMSLGK

SEQ ID NO: 918 - protein, 197 aa, Homo sapiens
  source 1..197: note = Homo sapiens Guanylate kinase
MSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESSKEPGLFDVVIINDSLDQAYAELKEALSEEIKKAQRTGA

SEQ ID NO: 919 - protein, 450 aa, Homo sapiens
  source 1..450: note = Homo sapiens LanC-like protein 2
MGETMSKRLKLHLGGEAEMEERAFVNPFPDYEAAAGALLASGAAEETGCVRPPATTDEPGLPFHQDGKIIHNFIRRIQTKIKDLLQQMEEGLKTADPHDCSAYTGWTGIALLYLQLYRVTCDQTYLLRSLDYVKRTLRNLNGRRVTFLCGDAGPLAVGAVIYHKLRSDCESQECVTKLLQLQRSVVCQESDLPDELLYGRAGYLYALLYLNTEIGPGTVCESAIKEVVNAIIESGKTLSREERKTERCPLLYQWHRKQYVGAAHGMAGIYYMLMQPAAKVDQETLTEMVKPSIDYVRHKKFRSGNYPSSLSNETDRLVHWCHGAPGVIHMLMQAYKVFKEEKYLKEAMECSDVIWQRGLLRKGYGICHGTAGNGYSFLSLYRLTQDKKYLYRACKFAEWCLDYGAHGCRIPDRPYSLFEGMAGAIHFLSDVLGPETSRFPAFELDSSKRD

SEQ ID NO: 920 - protein, 380 aa, Homo sapiens
  source 1..380: note = Homo sapiens GATOR complex protein
MGSGCRIECIFFSEFHPTLGPKITYQVPEDFISRELFDTVQVYIITKPELQNKLITVTAMEKKLIGCPVCIEHKKYSRNALLFNLGFVCDAQAKTCALEPIVKKLAGYLTTLELESSFVSMEESKQKLVPIMTILLEELNASGRCTLPIDESNTIHLKVIEQRPDPPVAQEYDVPVFTKDKEDFFNSQWDLTTQQILPYIDGFRHIQKISAEADVELNLVRIAIQNLLYYGVVTLVSILQYSNVYCPTPKVQDLVDDKSLQEACLSYVTKQGHKRASLRDVFQLYCSLSPGTTVRDLIGRHPQQLQHVDERKLIQFGLMKNLIRRLQKYPVRVTREEQSHPARLYTGCHSYDEICCKTGMSYHELDERLENDPNIIICWK

SEQ ID NO: 921 - protein, 555 aa, Homo sapiens
  source 1..555: note = Homo sapiens Solute carrier family 22 member 2
MPTTVDDVLEHGGEFHFFQKQMFFLLALLSATFAPIYVGIVFLGFTPDHRCRSPGVAELSLRCGWSPAEELNYTVPGPGPAGEASPRQCRRYEVDWNQSTFDCVDPLASLDTNRSRLPLGPCRDGWVYETPGSSIVTEFNLVCANSWMLDLFQSSVNVGFFIGSMSIGYIADRFGRKLCLLTTVLINAAAGVLMAISPTYTWMLIFRLIQGLVSKAGWLIGYILITEFVGRRYRRTVGIFYQVAYTVGLLVLAGVAYALPHWRWLQFTVSLPNFFFLLYYWCIPESPRWLISQNKNAEAMRIIKHIAKKNGKSLPASLQRLRLEEETGKKLNPSFLDLVRTPQIRKHTMILMYNWFTSSVLYQGLIMHMGLAGDNIYLDFFYSALVEFPAAFMIILTIDRIGRRYPWAASNMVAGAACLASVFIPGDLQWLKIIISCLGRMGITMAYEIVCLVNAELYPTFIRNLGVHICSSMCDIGGIITPFLVYRLTNIWLELPLMVFGVLGLVAGGLVLLLPETKGKALPETIEEAENMQRPRKNKEKMIYLQVQKLDIPLN

SEQ ID NO: 922 - protein, 456 aa, Homo sapiens [sequence omitted]

SEQ ID NO: 923 - protein, 450 aa, Homo sapiens
  source 1..450: note = Homo sapiens Beclin-1
MEGSKTSNNSTMQVSFVCQRCSQPLKLDTSFKILDRVTIQELTAPLLTTAQAKPGETQEEETNSGEEPFIETPRQDGVSRRFIPPARMMSTESANSFTLIGEASDGGTMENLSRRLKVTGDLFDIMSGQTDVDHPLCEECTDTLLDQLDTQLNVTENECQNYKRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRYRLVPYGNHSYLESLTDKSKELPLYCSGGLRFFWDNKFDHAMVAFLDCVQQFKEEVEKGETRFCLPYRMDVEKGKIEDTGGSGGSYSIKTQFNSEEQWTKALKFMLTNLKWGLAWVSSQFYNK

SEQ ID NO: 924 - protein, 349 aa, Homo sapiens
  source 1..349: note = Homo sapiens FK506-binding protein-like
METPPVNTIGEKDTSQPQQEWEKNLRENLDSVIQIRQQPRDPPTETLELEVSPDPASQILEHTQGAEKLVAELEGDSHKSHGSTSQMPEALQASDLWYCPDGSFVKKIVIRGHGLDKPKLGSCCRVLALGFPFGSGPPEGWTELTMGVGPWREETWGELIEKCLESMCQGEEAELQLPGHSGPPVRLTLASFTQGRDSWELETSEKEALAREERARGTELFRAGNPEGAARCYGRALRLLLTLPPPGPPERTVLHANLAACQLLLGQPQLAAQSCDRVLEREPGHLKALYRRGVAQAALGNLEKATADLKKVLAIDPKNRAAQEELGKVVIQGKNQDAGLAQGLRKMFG

SEQ ID NO: 925 - protein, 156 aa, Homo sapiens
  source 1..156: note = Homo sapiens Ribonuclease pancreatic
MALEKSLVRLLLLVLILLVLGWVQPSLGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 926 - protein, 1590 aa, Homo sapiens
  source 1..1590: note = Homo sapiens Probable global transcription activator SNF2L2
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 927 - protein, 211 aa, Homo sapiens
  source 1..211: note = Homo sapiens Metalloproteinase inhibitor 3
MTPWLGLIVLLGSWSLGDWGAEACTCSPSHPQDAFCNSDIVIRAKVVGKKLVKEGPFGTLVYTIKQMKMYRGFTKMPHVQYIHTEASESLCGLKLEVNKYQYLLTGRVYDGKMYTGLCNFVERWDQLTLSQRKGLNYRYHLGCNCKIKSCYYLPCFVTSKNECLWTDMLSNFGYPGYQSKHYACIRQKGGYCSWYRGWAPPDKSIINATDP

SEQ ID NO: 928 - protein, 281 aa, Homo sapiens [sequence omitted]

SEQ ID NO: 929 - protein, 687 aa, Homo sapiens
  source 1..687: note = Homo sapiens  Collagen alpha-1(XVIII) chain
GEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGQVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 930 - protein, 118 aa, synthetic construct
  source 1..118: note = B6H12 Anti-CD47 Antibody Heavy Chain Variable Region
EVQLVESGGDLVKPGGSLKLSCAASGFTFSGYGMSWVRQTPDKRLEWVATITSGGTYTYYPDSVKGRFTISRDNAKNTLYLQIDSLKSEDTAIYFCARSLAGNAMDYWGQGTSVTVSS

SEQ ID NO: 931 - protein, 118 aa, synthetic construct; identical to SEQ ID NO: 930
  source 1..118: note = B6H12 Anti-CD47 Antibody Light Chain Variable Region

SEQ ID NO: 932 - protein, 5 aa, synthetic construct
  source 1..5: note = B6H12 Anti-CD47 Antibody Heavy Chain CDR1
GYGMS

SEQ ID NO: 933 - protein, 16 aa, synthetic construct
  source 1..16: note = B6H12 Anti-CD47 Antibody Heavy Chain CDR2
TITSGGTYTYYPDSVK

SEQ ID NO: 934 - protein, 9 aa, synthetic construct
  source 1..9: note = B6H12 Anti-CD47 Antibody Heavy Chain CDR3
SLAGNAMDY

SEQ ID NO: 935 - protein, 11 aa, synthetic construct
  source 1..11: note = B6H12 Anti-CD47 Antibody Light Chain CDR1
RASQTISDYLH

SEQ ID NO: 936 - protein, 7 aa, synthetic construct
  source 1..7: note = B6H12 Anti-CD47 Antibody Light Chain CDR2
FASQSIS

SEQ ID NO: 937 - protein, 9 aa, synthetic construct
  source 1..9: note = B6H12 Anti-CD47 Antibody Light Chain CDR3
QNGHGFPRT

SEQ ID NO: 938 - protein, 116 aa, synthetic construct
  source 1..116: note = Hu5F9-G4 Anti-CD47 Antibody Heavy Chain Variable Region
QVQLQQPGAELVKPGASVMMSCKASGYTFTNYNMHWVKQTPGQGLEWIGTIYPGNDDTSYNQKFKDKATLTADKSSSAAYMQLSSLTSEDSAVYYCARGGYRAMDYWGQTSVTVSS

SEQ ID NO: 939 - protein, 112 aa, synthetic construct
  source 1..112: note = Hu5F9-G4 Anti-CD47 Antibody Light Chain Variable Region
DVLMTQTPLSLPVSLGDQASISCRSSQSIVYSNGNTYLGWYLQKPGQSPKLLIYKVSNRFSGVPDRFSGSGSGTDFTLKISRVEAEDLGVYHCFQGSHVPYTFGGGTKVEIK

SEQ ID NO: 940 - protein, 5 aa, synthetic construct
  source 1..5: note = Hu5F9-G4 Anti-CD47 Antibody Heavy Chain CDR1
NYNMH

SEQ ID NO: 941 - protein, 16 aa, synthetic construct
  source 1..16: note = Hu5F9-G4 Anti-CD47 Antibody Heavy Chain CDR2
TIYPGNDDTSYNQKFK

SEQ ID NO: 942 - protein, 8 aa, synthetic construct
  source 1..8: note = Hu5F9-G4 Anti-CD47 Antibody Heavy Chain CDR3
GGYRAMDY

SEQ ID NO: 943 - protein, 16 aa, synthetic construct
  source 1..16: note = Hu5F9-G4 Anti-CD47 Antibody Light Chain CDR1
RSSQSIVYSNGNTYLG

SEQ ID NO: 944 - protein, 7 aa, synthetic construct
  source 1..7: note = Hu5F9-G4 Anti-CD47 Antibody Light Chain CDR2
KVSNRFS

SEQ ID NO: 945 - protein, 9 aa, synthetic construct
  source 1..9: note = Hu5F9-G4 Anti-CD47 Antibody Light Chain CDR3
FQGSHVPYT

SEQ ID NO: 946 - protein, 120 aa, synthetic construct
  source 1..120: note = 8B6 Anti-CD47 Antibody Heavy Chain Variable Region
EVQLQQSGPELVKPGASVKMSCKASGYTFTTYVVHWVKQTPGQGLEWIGYINPYNDGTKYNEKFKGKATLTSDKSSSTAYMEFSSLTSEDSAVYYCVRGYYRYGYTMDYWGQGTSVTVSS

SEQ ID NO: 947 - protein, 107 aa, synthetic construct
  source 1..107: note = 8B6 Anti-CD47 Antibody Light Chain Variable Region
DIVMTQSPATLSVTPGDRVSLSCRASQNFSDYLHWYQQKSHESPRLLIKYVSHSISGIPSRFSGSGSGSDFTLSINSVEPEDVGVYYCQNGHSFPPTFGGGTKLEIK

SEQ ID NO: 948 - protein, 5 aa, synthetic construct
  source 1..5: note = 8B6 Anti-CD47 Antibody Heavy Chain CDR1
TYVVH

SEQ ID NO: 949 - protein, 16 aa, synthetic construct
  source 1..16: note = 8B6 Anti-CD47 Antibody Heavy Chain CDR2
YINPYNDGTKYNEKFK

SEQ ID NO: 950 - protein, 11 aa, synthetic construct
  source 1..11: note = 8B6 Anti-CD47 Antibody Heavy Chain CDR3
GYYRYGYTMDY

SEQ ID NO: 951 - protein, 11 aa, synthetic construct
  source 1..11: note = 8B6 Anti-CD47 Antibody Light Chain CDR1
RASQNFSDYLH

SEQ ID NO: 952 - protein, 7 aa, synthetic construct
  source 1..7: note = 8B6 Anti-CD47 Antibody Light Chain CDR2
YVSHSIS

SEQ ID NO: 953 - protein, 9 aa, synthetic construct
  source 1..9: note = 8B6 Anti-CD47 Antibody Light Chain CDR3
QNGHSFPPT

SEQ ID NO: 954 - protein, 116 aa, synthetic construct
  source 1..116: note = C3 Anti-CD47 Antibody Heavy Chain Variable Region
QVQLQQSGAELVKPGASVKLSCKASGYTFTNYYIFWVKERPGQGLEWIGDINPSNGDTNFNEKFKIKATLTVDKSSSTTYMQLNSLTSEDSAVYFCTRGGYTMDYWGQGTSVTVSS

SEQ ID NO: 955 - protein, 112 aa, synthetic construct
  source 1..112: note = C3 Anti-CD47 Antibody Light Chain Variable Region
DVVMTQTPLSLPVSLGDQASISCRSSQSLVHSNGNTYFHWYVQKPGQSPKLLIYKVSYRFSGVPDRFSGSGSGTDFTLKISRVEAEDLGVYFCSQSTHVPRTFGGGTKLEIK

SEQ ID NO: 956 - protein, 5 aa, synthetic construct
  source 1..5: note = C3 Anti-CD47 Antibody Heavy Chain CDR1
NYYIF

SEQ ID NO: 957 - protein, 16 aa, synthetic construct
  source 1..16: note = C3 Anti-CD47 Antibody Heavy Chain CDR2
DINPSNGDTNFNEKFK

SEQ ID NO: 958 - protein, 7 aa, synthetic construct
  source 1..7: note = C3 Anti-CD47 Antibody Heavy Chain CDR3
GGYTMDY

SEQ ID NO: 959 - protein, 16 aa, synthetic construct
  source 1..16: note = C3 Anti-CD47 Antibody Light Chain CDR1
RSSQSLVHSNGNTYFH

SEQ ID NO: 960 - protein, 7 aa, synthetic construct
  source 1..7: note = C3 Anti-CD47 Antibody Light Chain CDR2
KVSYRFS

SEQ ID NO: 961 - protein, 9 aa, synthetic construct
  source 1..9: note = C3 Anti-CD47 Antibody Light Chain CDR3
SQSTHVPRT

SEQ ID NO: 962 - protein, 345 aa, synthetic construct
  source 1..345: note = ALX148 SIRP alpha D1 variant fused to Fc domain monomer
EEELQIIQPDKSVLVAAGETATLRCTITSLFPVGPIQWFRGAGPGRELIYNQREGPFPRVTTVSDTTKRNNMDFSIRIGAITPADAGTYYCVKFRKGSPDDVEFKSGAGTELSVRAKPSDKTHTCPPCPAPEAAGAPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 963 - protein, 345 aa, synthetic construct
  source 1..345: note = TTI-621 IgV SIRP alpha variant 2 domain fused to human IgG1 constant region
EEELQVIQPDKSVSVAAGESAILHCTVTSLIPVGPIQWFRGAGPARELIYNQKEGHFPRVTTVSESTKRENMDFSISISNITPADAGTYYCVKFRKGSPDTEFKSGAGTELSVRAKPSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 964 - protein, 347 aa, synthetic construct
  source 1..347: note = TTI-622 IgV SIRP alpha variant 2 domain fused to human IgG4 constant region
EEELQVIQPDKSVSVAAGESAILHCTVTSLIPVGPIQWFRGAGPARELIYNQKEGHFPRVTTVSESTKRENMDFSISISNITPADAGTYYCVKFRKGSPDTEFKSGAGTELSVRAKPSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 965 - DNA, 29 bp, synthetic construct
  source 1..29: mol_type = other DNA
  modified_base 29: mod_base = OTHER; note = 3' deoxythymidine C6 amine modifer
  misc_feature 1..27: note = RNA
  misc_feature 28..29: note = DNA
cggggatattaatactacttcagtacatt

SEQ ID NO: 966 - DNA, 29 bp, synthetic construct
  source 1..29: mol_type = other DNA
  modified_base 29: mod_base = OTHER; note = deoxythymidine carboxyfluorescein
  misc_feature 1..27: note = RNA
  misc_feature 28..29: note = DNA
tgtactgaagtagtattaatatccccgtt
